US006489455B2

(12) United States Patent
Chenchik et al.

(10) Patent No.: US 6,489,455 B2
(45) Date of Patent: Dec. 3, 2002

(54) METHODS OF ASSAYING DIFFERENTIAL EXPRESSION

(75) Inventors: Alex Chenchik, Palo Alto; George Jokhadze, Mountain View, both of CA (US); Robert Bibilashvilli, Moscow (RU)

(73) Assignee: Clontech Laboratories, Inc., Palo Alto, CA (US)

( * ) Notice: Subject to any disclaimer, the term of this patent is extended or adjusted under 35 U.S.C. 154(b) by 0 days.

(21) Appl. No.: 09/225,201

(22) Filed: Jan. 5, 1999

(65) Prior Publication Data

US 2001/0007744 A1 Jul. 12, 2001

Related U.S. Application Data

(63) Continuation-in-part of application No. 08/859,998, filed on May 21, 1997, now Pat. No. 5,994,076.

(51) Int. Cl.$^7$ .......................... C07H 21/02; C12Q 1/68; C12P 19/34
(52) U.S. Cl. ...................... 536/23.1; 435/6; 435/91.1; 435/91.2
(58) Field of Search .................... 435/6, 91.2, 91.1; 536/23.1

(56) References Cited

U.S. PATENT DOCUMENTS

| | | | |
|---|---|---|---|
| 4,800,159 A | * | 1/1989 | Mullis et al. ............... 435/91.2 |
| 4,888,274 A | | 12/1989 | Radding et al. |
| 5,162,209 A | | 11/1992 | Scheele |
| 5,223,414 A | | 6/1993 | Zarling et al. |
| 5,387,510 A | | 2/1995 | Wu |
| 5,434,047 A | | 7/1995 | Arnold, Jr. |
| 5,436,327 A | | 7/1995 | Southern et al. |
| 5,449,603 A | | 9/1995 | Nielson et al. |
| 5,468,613 A | | 11/1995 | Erlich et al. |
| 5,487,985 A | | 1/1996 | McClelland et al. |
| 5,503,980 A | | 4/1996 | Cantor |
| 5,512,462 A | | 4/1996 | Cheng |
| 5,547,843 A | | 8/1996 | Studier |
| 5,580,726 A | | 12/1996 | Villeponteau et al. |
| 5,599,672 A | | 2/1997 | Liang et al. |
| 5,817,461 A | * | 10/1998 | Austin et al. ................... 435/6 |
| 6,013,435 A | * | 1/2000 | Nusbaum ....................... 435/6 |
| 6,110,711 A | * | 8/2000 | Serafini et al. ........... 435/91.21 |

FOREIGN PATENT DOCUMENTS

| | | |
|---|---|---|
| WO | WO 99/01302 | 2/1988 |
| WO | WO 89/11548 | 11/1989 |
| WO | 0 481 065 B1 | 4/1992 |
| WO | WO 95/21944 | 8/1995 |

OTHER PUBLICATIONS

Pease et al., "Light–generated oligonucleotide arrays for rapid DNA sequence analysis" Proc. Natl. Acad. Sci. USA vol. 91, pp. 5022–5026, 1994.*

Shoffner et al., "Chip PCR. I. Surface passivation of micro-fabricated silicon–glass chips for PCR" Nucleic Acids Research vol. 24, pp. 375–379, 1996.*
GibcoBRL Product Catalogue and Reference Guide: 1995–1996.*
Bauer, David et al., "Identification of Differentially Expressed mRNA Species By An Improved Display Technique (DDRT–PCR)", *Nucleic Acids Research* (1993) vol. 21 No. 18; 4272–4280.
Chalifour, Lorraine et al., "A Method For Analysis of Gene Expression Patterns", *Analytical Biochemistry* (1994) vol. 216:299–304.
DeRisi, Joseph et al., "Use of A cDNA Microarray To Analyse GeneExpression Patterns In Human Cancer", *Nature Genetics* vol. 14:457–460.
Ehlers, et al., "Differentiation Of t Cell Lymphokine Gene Expression: The In Vitro Acquisition of T Cell Memory", *J. Exp. Med.* (1991) vol. 173;25–36.
Goodwin, Raymond G., et al., "Human Interleukin 7: Molecular Cloning and Growth Factor Activity on Human and Murine B–Lineage Cells," *Proc. Natl. Acad. Sci. USA* (Jan. 1989) vol. 86:302–306.
Goodwin, et al., "Cloning Of The Human And Murine Interleukin 7 Receptors: Demonstration Of A Soluble Form And Homology To A New Receptor Superfamily," *Cell* (1990) vol. 60;941–951.
Heller, Renu et al., "Discovery and Analysis of Inflammatory Disease–Related Genes Using cDNA Microarrays", *Proc. Nat.l Acad. Sci. USA* (1997) vol. 94:2150–2155.
Ikonomov, Ognian, et al., "Differential Display Protocol With Selected Primers That Preferentially Isolates mRNAs of Moderate–to–Low–Abundance in a Microscopic System", *BioTechniques* (1996) vol. 20 No. 6; 1030–1042.
Leonard, Warren J., et al., "Molecular Cloning and Expression of cDNAs for the Human Interleukin–2 Receptor," *Nature* (Oct. 1984) vol. 311:626–631.
Liang, Peng et al., "Differential Display of Eukaryotic Messenger RNA by Means of the Polymerase Chain Reaction", *Science* (1992) vol. 257 :967–971.
Liang, Peng et al., "Recent Advances in Differential Display", *Current Opinion in Immunology* (1995) vol. 7; 274–280.
Lockhart, David et al., "Expression Monitoring By Hybridization to High–Density Oligonucleotide Arrays", *Nature Biotechnology* (1996) vol. 14: 1675–1680.

(List continued on next page.)

*Primary Examiner*—John S. Brusca
*Assistant Examiner*—Young Kim
(74) *Attorney, Agent, or Firm*—Bret E. Field; Bozicevic, Field & Francis

(57) ABSTRACT

Methods and compositions are provided for analyzing differences in the RNA profiles between a plurality of different physiological samples. In the subject methods, a set of a representational number of distinct gene specific primers is used to generate labeled nucleic acids from each of the different physiological samples. The labeled nucleic acids are then compared to each other and differences in the RNA profiles are determined. The subject methods find use in methods of identifying differential gene expression.

11 Claims, No Drawings

OTHER PUBLICATIONS

Nguyen, Catherine et al., "Differential Gene Expression in the Murine Thymus Assayed by Quantitative Hybridization of Arrayed cDNA Clones", *Genomics* (1995) vol. 29:207–216.

Nishi, Tatsunari et al., "Cloning and Expression of a Novel Variant of Human Interferon–γ cDNA," *J. Biochem* (1985) vol. 97:153–159.

Pietu, Genevieve et al., "Novel Gene Transcripts Preferentially Expressed in Human Muscles Revealed by Quantitative Hybridization of a High Density cDNA Array", *Genome Research* (1996) vol. 6:492–503.

Prashar, Yatindra et al., "Analysis of Differential Gene Expression by Display of 3' End Restriction Fragments of cDNAs", *Proc. Nat.l Acad.Sci. USA* (1996) vol. 93: 659–663.

Schena, Mark et al., "Quantitative Monitoring of Gene Expression Patterns With a Complementary DNA Microarray", *Science* (1995) vol. 270:467–470.

Schena, Mark et al., "Parallel Human Genome Analysis: Microarray–Based Expression Monitoring of 1000 Genes", *Proc. Nat.l Acad. Sci USA* (1996) vol. 93:10614–10619.

Shalon, Dari et al., "A DNA Microarray System for Analyzing Complex DNA Samples Using Two–Color Fluorescent Probe Hybridization", *Genome Research* (1996) vol. 6: 639–645.

Sokolov, Boris et al., "A Rapid and Simple PCR–based Method For Isolation of cDNAs from Differentially Expressed Genes", *Nucleic Acids Research* (1994) vol. 22, No. 19; 4009–4015.

Zhao, Nanding et al., "High–Density cDNA Filter Analysis: A Novel Approach for Large–Scale, Quantitative Analysis of Gene Expression", *Gene* (1995) vol. 156: 207–213.

"Atlas™ Human cDNA Expression Array I", *Clontechniques* Apr. 1997; 4–7.

\* cited by examiner

METHODS OF ASSAYING DIFFERENTIAL EXPRESSION

CROSS-REFERENCE TO RELATED APPLICATIONS

This application is a continuation-in-part of application Ser. No. 08/859,998, now U.S. Pat. No. 5,994,076 filed May 21, 1997, the disclosure of which is herein incorporated by reference.

INTRODUCTION

1. Technical Field

The technical field of this invention is the analysis of differential gene expression.

2. Background

In higher organisms, any given cell expresses only a fraction of the total number of genes present in its genome. The small fraction of the total number of genes that is expressed determine the life processes carried out by the cell, e.g. development and differentiation, homeostasis, response to insults, cell cycle regulation, aging, apoptosis, and the like. Alterations in gene expression decide the course of normal cell development and the appearance of diseased states, such as cancer. Because the choice of which genes are expressed has such a profound effect on the nature of any given cell, methods of analyzing gene expression are of critical import to basic molecular biological research. Identification of differentially-expressed genes can provide a key to diagnosis, prognosis and treatment of a variety of diseases or condition states in animals, including humans, and plants. Additionally, these methods can be used to identify differentially-expressed sequences due to changes in gene expression level associated with predisposition to disease, influence of external treatments, factors or infectious agents. Identification of such genes helps in development of new drugs and diagnostic methods for treating or preventing the occurrence of such diseases.

One way of analyzing gene expression in a particular cell is to perform differential gene expression assays, in which the expression of genes in different cells is compared and any discrepancies in expression are identified, where the presence of discrepancies indicates a difference in the classes of genes expressed in the cells being compared.

One method currently employed to identify differentially expressed genes begins with the generation of cDNA "targets" obtained from analogous cells, tissues or organs of a healthy and diseased organism. The cDNA targets are then hybridized to a set of target nucleic acid "probe" fragments immobilized on membrane. Differences between he resultant hybridization patterns are then detected and related to differences in gene expression in the two sources. In this procedure the number of analyzed gene-specific probes can reach several hundred thousand.

Modifications have been made to the above basic method in order to obtain improved results. These modifications include replacement of the traditional radioactive labeling procedure of the target nucleic acid sequences with nonisotopic labels, mainly fluorescent labels. Other modifications have focused on improved methods of immobilization of an array of the probe nucleic acids to surfaces of a variety of solid supports.

Despite the promise of analysis of differential expression using arrays of probes on solid supports, there is a continuing need for improvement of the methods currently employed by researchers. In current methods, hybridization of "target" to "probe" is slow. Furthermore, a number of additional events such as competitive hybridization events between distinct target sequences, nonspecific binding between "target" and "probe," and formation of secondary structures in target sequences can occur which adversely effect the results.

Accordingly, there is continued interest in the development of new methods of analyzing differential gene expression, where such methods provide for fast hybridization and high specificity of binding of "targets" to "probes."

Relevant Literature

Patents of interest include: EP 0 328 829 B1 and U.S. Pat. Nos. 5,468,613; 5,580,726; 5,599,672; 5,512,462; 5,162,209 and 5,162,209. Methods of analyzing differential gene expression are also described in Maniatis, et al., Molecular Cloning, A Laboratory Manual, (Cold Spring Harbor Press, Cold Spring Harbor, N.Y.)(1989); Nucleic Acid Hybridization, A Practical Approach (Hames, B. D., and Higgins, S. J. eds, IRL Press, Oxford)(1985); WO 95/21944; Chalifour, et al., Anal. Biochem. (1994) 216: 299–304; Nguyen et al., Genomics (1995) 29: 207–216; Pietu et al., Genome Res. (1996) 6: 492–503; and Zhao et al., Gene (1995) 166: 207–213.

Use of non-isotopic labels in methods of differential gene expression analysis are described in: Schena et al. Science (1995) 270: 467–470; Schena et al., Proc. Natl. Acad. Sci. USA (1996) 93: 10614–10619; DeRisi et al., Nature Genet. (1996) 14: 457–460; and Lockhart et al., Nature Biotechnol. (1996) 14: 1675–1680.

Methods of stably associating probes to the surface of substrates are described in: Hermanson, et al. Immobilized Affinity Ligand Techniques, Academic Press, (1992); WO 89/11548; European Patent No. 0 281 390 B1; WO 88/01302; European Patent Application No. 0392546; U.S. Pat. No. 5,436,327; U.S. Pat. No. 5,445,934.

Methods of improving hybridization of target to substrate surface associated probe are described in: EP 0 318 245 B1 (solution hybridization of probe to target followed by binding of hybridization complex to surface of substrate); Lockhart et al., Nature Biotechnol. (1996) 14: 1675–1680, EP 0 328 829 B1 (preamplification of target DNA/RNA); Maniatis et al., *Molecular Cloning*, A Laboratory Manual (Cold Spring Harbor Press, Cold Spring Harbor, N.Y., (1989), Nucleic Acid Hybridization, A Practical Approach (Hames, B. D., and Higgins, S. J. eds. IRL Press, Oxford) (1985), EP 0 229 442 (addition of an inert polymers such as dextran sulfate); U.S. Pat. No. 5,387,510, EP 0 318 245 B1 (use of "helper" oligonucleotides which reorder secondary and tertiary structure of target polynucleotide); WO 89/11548 (attaching probes to surface of substrate through long spacer arms).

Methods of improving specificity of hybridization are described in: U.S. Pat. Nos. 5,449,603 & 5,547,843 (use of single stranded nucleic acid binding protein); U.S. Pat. Nos. 4,888,274 & 5,223,414, EP 0 481 065 B1 (use of RecA protein-coated nucleoprotein target molecules); Khrapko et al., FEBS Lett. (1989) 256: 118–122 and U.S. Pat. No. 5,503,980 (continuous stacking interaction between short oligonucleotides of target and probe molecules, followed by enzymatic ligation step); and U.S. Pat. No. 5,434,047 (use of non-target probe which hybridized with non-target nucleic acid).

SUMMARY OF THE INVENTION

Methods and compositions for identifying differences between the nucleic acid profiles of a plurality of biological samples are provided. In the subject methods, a set of a representational number of different gene specific primers is used to generate labeled target nucleic acids from samples of nucleic acids, usually ribonucleic acids, derived from at least two different physiological sources. The labeled target nucleic acids derived from each physiological source are then compared, preferably by hybridization to arrays of probe nucleic acids stably associated with the surface of a substrate. The subject methods find use in differential gene expression analysis.

DESCRIPTION OF THE SPECIFIC EMBODIMENTS

Methods and compositions are provided for analyzing differences in the ribonucleic acid profiles between two or more physiological sources. In the subject methods, a set of a representational number of gene specific primers is used to generate labeled target nucleic acids from the physiological sources. The labeled target nucleic acids from each of the samples are then compared, preferably by hybridizing the labeled target nucleic acids from each sample to an array of probe nucleic acids stably associated with the surface of a substrate. Also provided are sets of gene specific primers employed in the subject methods, as well as kits comprising the sets of gene specific primers. The subject methods find use in a variety of applications, including differential gene expression assays.

Before the subject invention is further described, it is to be understood that the invention is not limited to the particular embodiments of the invention described below, as variations of the particular embodiments may be made and still fall within the scope of the appended claims. It is also to be understood that the terminology employed is for the purpose of describing particular embodiments, and is not intended to be limiting. Instead, the scope of the present invention will be established by the appended claims.

It must be noted that as used in this specification and the appended claims, the singular forms "a," "an," and "the" include plural reference unless the context clearly dictates otherwise. Unless defined otherwise all technical and scientific terms used herein have the same meaning as commonly understood to one of ordinary skill in the art to which this invention belongs.

Critical to the subject invention is the use of a set (i.e. pool, mixture, collection) of a representational number of gene specific primers to generate labeled nucleic acids from a sample of nucleic acids, usually ribonucleic acids (RNAs), where the labeled nucleic acids may act as "target" in subsequent hybridization assays, described in greater detail below. As used herein, the term nucleic acid is used in the broadest sense to refer to any sized multimer of nucleotide monomeric units, including short multimers such as dimers, trimers and the like, as well as longer multimers such as oligonucleotides and polynucleotides, where oligonucleotides generally denotes single stranded nucleotide multimers of from about 10 to 100 nucleotides and up to 200 nucleotides in length, and polynucleotides typically refers to single or double stranded nucleotide monomers of generally greater than 100 nucleotides in length.

As the subject sets comprise a representational number of primers, the total number of different primers in any given set will be only a fraction of the total number of different or distinct RNAs in the sample, where the total number of primers in the set will generally not exceed 80%, usually will not exceed 50% and more usually will not 20% of the total number of distinct RNAs, usually the total number of distinct messenger RNAs (mRNAs), in the sample. Any two given RNAs in a sample will be considered distinct or different if they comprise a stretch of at least 100 nucleotides in length in which the sequence similarity is less then 98%, as determined using the FASTA program (default settings). As the sets of gene specific primers comprise only a representational number of primers, with physiological sources comprising from 5,000 to 50,000 distinct RNAs, the number of different gene specific primers in the set of gene specific primers will typically range from about 20 to 10,000, usually from 50 to 2,000 and more usually from 75 to 1500.

Each of the gene specific primers of the sets described above will be of sufficient length to specifically hybridize to a distinct nucleic acid member of the sample, e.g. RNA or cDNA, where the length of the gene specific primers will usually be at least 8 nt, more usually at least 20 nt and may be as long as 25 nt or longer, but will usually not exceed 50 nt. The gene specific primers will be sufficiently specific to hybridize to complementary template sequence during the generation of labeled nucleic acids under conditions sufficient for first strand cDNA synthesis, which conditions are known by those of skill in the art. The number of mismatches between the gene specific primer sequences and their complementary template sequences to which they hybridize during the generation of labeled nucleic acids in the subject methods will generally not exceed 20%, usually will not exceed 10% and more usually will not exceed 5%, as determined by FASTA (default settings).

Generally, the sets of gene specific primers will comprise primers that correspond to at least 20, usually at least 50 and more usually at least 75 distinct genes as represented by distinct mRNAs in the sample, where the term "distinct" when used to describe genes is as defined above, where any two genes are considered distinct if they comprise a stretch of at least 100 nt in their RNA coding regions in which the sequence similarity does not exceed 98%, as determined by FASTA (default settings).

The gene specific oligonucleotide primers may be synthesized by conventional oligonucleotide chemistry methods, where the nucleotide units may be: (a) solely nucleotides comprising the heterocyclic nitrogenous bases found in naturally occurring DNA and RNA, e.g. adenine, cytosine, guanine, thymine and uracil; (b) solely nucleotide analogs which are capable of base pairing under hybridization conditions in the course of DNA synthesis such that they function as the above nucleotides found in naturally occurring DNA and RNA, where illustrative nucleotide analogs include inosine, xanthine, hypoxanthine, 1,2-diaminopurine and the like; or (c) from combinations of the nucleotides of (a) and nucleotide analogs of (b), where with primers comprising a combination of nucleotides and analogues thereof, the number of nucleotide analogues in the primers will typically be less than 25 and more typically less than 5. The gene specific primers may comprise reporter or hapten groups, usually 1 to 2, which serve to improve hybridization properties and simplify detection procedure.

Depending on the particular point at which the gene specific primers are employed in the generation of the labeled nucleic acids, e.g during first strand eDNA synthesis or following one or more distinct amplification steps, each gene specific primer may correspond to a particular RNA by being complementary or similar, where similar usually means identical, to the particular RNA. For example, where the gene specific primers are employed in the synthesis of first strand cDNA, the gene specific primers will be complementary to regions of the RNAs to which they correspond.

Each gene specific primer can be complementary to a sequence of nucleotides which is unique in the population of nucleic acids, e.g. mRNAs, with which the primers are contacted, or one or more of the gene specific primers in the set may be complementary to several nucleic acids in a given population, e.g. multiple mRNAs, such that the gene specific primer generates labeled nucleic acid when one or more of set of related nucleic acid species, e.g. species having a conserved region to which the primer corresponds, are present in the sample. Examples of such related nucleic acid species include those comprising: repetitive sequences, such as Alu repeats, Al repeats and the like; homologous sequences in related members of a gene-family; polyadenylation signals; splicing signals; or arbitrary but conversed sequences.

The gene specific primers of the sets of primers according to the subject invention are typically chosen according to a number of different criteria. In some embodiments of the invention, primers of interest for inclusion in the set include primers corresponding to genes which are typically differentially expressed in different cell types, in disease states, in response to the influence of external agents, factors or infectious agents, and the like. In other embodiments, primers of interest are primers corresponding to genes which are expected to be, or already identified as being, differentially expressed in different cell, tissue or organism types. Preferably, at least 2 different gene functional classes will be represented in the sets of gene specific primers, where the number of different functional classes of genes represented in the primer sets will generally be at least 3, and will usually be at least 5. In other words, the sets of gene specific primers comprise nucleotide sequences complementary to RNA transcripts of at least 2 gene functional classes, usually at least 3 gene functional classes, and more usually at least 5 gene functional classes. Gene functional classes of interest include oncogenes; genes encoding tumor suppressors; genes encoding cell cycle regulators; stress response genes; genes encoding ion channel proteins; genes encoding transport proteins; genes encoding intracellular signal transduction modulator and effector factors; apoptosis related genes; DNA synthesis/recombination/repair genes; genes encoding transcription factors; genes encoding DNA-binding proteins; genes encoding receptors, including receptors for growth factors, chemokines, interleukins, interferons, hormones, neurotransmitters, cell surface antigens, cell adhesion molecules etc.; genes encoding cell-cell communication proteins, such as growth factors, cytokines, chemokines, interleukins, interferons, hormones etc.; and the like. Less preferred are gene specific primers that are subject to formation of strong secondary structures with less than −10 kcal/mol; comprise stretches of homopolymeric regions, usually more than 5 identical nucleotides; comprise more than 3 repetitive sequences; have high, e.g. more than 80%, or low, e.g. less than 30%, GC content etc.

The particular genes represented in the set of gene specific primers will necessarily depend on the nature of physiological source from which the RNAs to be analyzed are derived. For analysis of RNA profiles of eukaryotic physiological sources, the genes to which the gene specific primers correspond will usually be Class II genes which are transcribed into RNAs having 5' caps, e.g. 7-methyl guanosine or 2,2,7-trimethylguanosine, where Class II genes of particular interest are those transcribed into cytoplasmic mRNA comprising a 7-methyl guanosine 5' cap and a polyA tail.

For analysis of RNA profiles of mammalian physiological sources, of particular interest are gene specific primers corresponding to the functional gene classes listed above. For analysis of RNA profiles of human physiological sources, the gene specific primers of particular interest are the gene specific primers identified in Table 1 of application Ser. No. 08/859,008 filed May 21, 1997 (the disclosure of which is herein incorporated by reference) as SEQ ID NO:01 to SEQ ID NO:1372, where sets of these primers will usually include at least 20 and more usually at least 50 of these specific sequences. Also of interest are those gene specific primers corresponding to those genes (and specific capable of producing target capable of hybridizing to those specific regions of the genes) as listed in the following copending patent applications, the disclosures of which are herein incorporated by reference: U.S. application Ser. No. 09/221,480 entitled Apoptosis Array; U.S. application Ser. No. 09/222,432 entitled Cancer Array; U.S. application Ser. No. 09/222,436 entitled Cell Cycle Array; U.S. application Ser. No. 09/222,437 entitled Cell Interaction Array; U.S. application Ser. No. 09/222,251 entitled Cytokine Receptor Array; U.S. application Ser. No. 09/221,481 entitled Human Array; U.S. application Ser. No. 09/222,256 entitled Human Stress Array; U.S. application Ser. No. 09/222,248 entitled Mouse Array; and U.S. application Ser. No. 09/222,253 entitled Oncogene/Tumor Suppressor Array.

Depending on the particular nature of the labeled nucleic acid generation step of the subject methods, the gene specific primers may be modified in a variety of ways. One way the gene specific primers may be modified is to include an anchor sequence of nucleotides, where the anchor is usually located 5' of the gene specific portion of the primer and ranges in length from 10 to 50 nt in length, usually 15 to 40 nt in length. The anchor sequence may comprise a sequence of bases which serves a variety of functions, such as a sequence of bases which correspond to the sequence found in promoters for bacteriophage RNA polymerase, e.g. T7 polymerase, T3 polymerase, SP6 polymerase, and the like; arbitrary sequences which can serve as subsequent primer binding sites; and the like.

Turning now to the methods employing the above sets of gene specific primers, the first step in the subject methods is to obtain a sample of nucleic acids, usually RNAs or nucleic acid derivatives thereof, from a physiological source, usually a plurality of physiological sources, where the term plurality is used to refer to 2 or more distinct physiological sources. The physiological source of RNAs will typically be eukaryotic, with physiological sources of interest including sources derived single celled organisms such as yeast and multicellular organisms, including plants and animals, particularly mammals, where the physiological sources from multicellular organisms may be derived from particular organs or tissues of the multicellular organism, or from isolated cells derived therefrom. Thus, the physiological sources may be different cells from different organisms of the same species, e.g. cells derived from different humans, or cells derived from the same human (or identical twins) such that the cells share a common genome, where such cells will usually be from different tissue types, including normal and diseased tissue types, e.g. neoplastic, cell types. In obtaining the sample of RNAs to be analyzed from the physiological source from which it is derived, the physiological source may be subjected to a number of different processing steps, where such processing steps might include tissue homogenation, nucleic acid extraction and the like, where such processing steps are known to the those of skill in the art. Methods of isolating RNA from cells, tissues, organs or whole organisms are known to those of skill in the art and are described in Maniatis et al., Molecular Cloning: A Laboratory Manual (Cold Spring Harbor Press)(1989).

The next step in the subject methods is the generation of labeled nucleic acids representative of the nucleic acid, usually RNA, profile of the physiological source. As mentioned above, a set or pool of gene specific primers is used to generate the labeled nucleic acids from the sample of RNAs, where the labeled nucleic acids generated in this step may serve as "target" in subsequent assays in which the differences in the RNA profiles of at least two sources are analyzed. Since the subject sets or pools of primers are employed, a sub-population of nucleic acids is generated from the initial source, where the sub-population corresponds to only a portion or fraction of the initial nucleic acid source. As used herein, the term "target" refers to single stranded RNA, single stranded DNA and double stranded DNA, where the target is generally greater than 50 nt in length.

The set of primers may be used either in first strand cDNA synthesis or following one or more amplification steps. Furthermore, the actual synthesis of the labeled nucleic acids may be at the same step during which the sets of gene specific primers are employed, or the synthesis of the labeled nucleic acids may be one more steps subsequent to the step in which the sets of gene specific primers are employed.

In a first embodiment of the invention, the set of gene specific primers is used to generate labeled first strand cDNA, where the labeled first strand cDNA is representative of the RNA profile of the physiological source being assayed. The labeled first strand cDNA is prepared by contacting the RNA sample with the primer set and requisite reagents under conditions sufficient for hybrid duplexes (i.e. double stranded primer complexes) to be produced followed by reverse transcription of the RNA template in the sample. Requisite reagents contacted with the primers and RNAs are known to those of skill in the art and will generally include at least an enzyme having reverse transcriptase activity and dNTPs in an appropriate buffer medium.

A variety of enzymes, usually DNA polymerases, possessing reverse transcriptase activity can be used for the first strand cDNA synthesis step. Examples of suitable DNA polymerases include the DNA polymerases derived from organisms selected from the group consisting of a thermophilic bacteria and archaebacteria, retroviruses, yeasts, Neurosporas, Drosophilas, primates and rodents. Preferably, the DNA polymerase will be selected from the group consisting of Moloney murine leukemia virus (M-MLV) as described in U.S. Pat. No. 4,943,531 and M-MLV reverse transcriptase lacking RNaseH activity as described in U.S. Pat. No. 5,405,776 (the disclosures of which patents are herein incorporated by reference), human T-cell leukemia virus type I (HTLV-I), bovine leukemia virus (BLV), Rous sarcoma virus (RSV), human immunodeficiency virus (HIV) and Thermus aquaticus (Taq) or Thermus thermophilus (Tth) as described in U.S. Pat. No. 5,322,770, the disclosure of which is herein incorporated by reference. Suitable DNA polymerases possessing reverse transcriptase activity may be isolated from an organism, obtained commercially or obtained from cells which express high levels of cloned genes encoding the polymerases by methods known to those of skill in the art, where the particular manner of obtaining the polymerase will be chosen based primarily on factors such as convenience, cost, availability and the like.

The various dNTPs and buffer medium necessary for first strand cDNA synthesis through reverse transcription of the primed RNAs may be purchased commercially from various sources, where such sources include Clontech, Sigma, Life Technologies, Amersham, Boehringer-Mannheim. Buffer mediums suitable for first strand synthesis will usually comprise buffering agents, usually in a concentration ranging from 10 to 100 μM which typically support a pH in the range 6 to 9, such as Tris-HCl, HEPES-KOH, etc.; salts containing monovalent ions, such as KCl, NaCl, etc., at concentrations ranging from 0–200 mM; salts containing divalent cations like $MgCl_2$, Mg(OAc) etc, at concentrations usually ranging from 1 to 10 mM; and additional reagents such as reducing agents, e.g. DDT, detergents, albumin and the like. The conditions of the reagent mixture will be selected to promote efficient first strand synthesis. Typically the set of primers will first be combined with the RNA sample at an elevated temperature, usually ranging from 50 to 95° C., followed by a reduction in temperature to a range between about 0 to 60° C., to ensure specific annealing of the primers to their corresponding RNAs in the sample. Following this annealing step, the primed RNAs are then combined with dNTPs and reverse transcriptase under conditions sufficient to promote reverse transcription and first strand cDNA synthesis of the primed RNAs. By using appropriate types of reagents, all of the reagents can be combined at once if the activity of the polymerase can be postponed or timed to start after annealing of the primer to the RNA.

In this embodiment, one of either the gene specific primers or dNTPs, preferably the dNTPs, will be labeled such that the synthesized cDNAs are labeled. By labeled is meant that the entities comprise a member of a signal producing system and are thus detectable, either directly or through combined action with one or more additional members of a signal producing system. Examples of directly detectable labels include isotopic and fluorescent moieties incorporated into, usually covalently bonded to, a nucleotide monomeric unit, e.g dNTP or monomeric unit of the primer. Isotopic moieties or labels of interest include $^{32}p$, $^{33}p$, $^{35}S$, $^{125}I$, and the like. Fluorescent moieties or labels of interest include coumarin and its derivatives, e.g. 7-amino-4-methylcoumarin, aminocoumarin, bodipy dyes, such as Bodipy FL, cascade blue, fluorescein and its derivatives, e.g. fluorescein isothiocyanate, Oregon green, rhodamine dyes, e.g. texas red, tetramethylrhodamine, eosins and erythrosins, cyanine dyes, e.g. Cy3 and Cy5, macrocyclic chelates of lanthanide ions, e.g. quantum dye™, fluorescent energy transfer dyes, such as thiazole orange-ethidium heterodimer, TOTAB, etc. Labels may also be members of a signal producing system that act in concert with one or more additional members of the same system to provide a detectable signal. Illustrative of such labels are members of a specific binding pair, such as ligands, e.g. biotin, fluorescein, digoxigenin, antigen, polyvalent cations, chelator groups and the like, where the members specifically bind to additional members of the signal producing system, where the additional members provide a detectable signal either directly or indirectly, e.g. antibody conjugated to a fluorescent moiety or an enzymatic moiety capable of converting a substrate to a chromogenic product, e.g. alkaline phosphatase conjugate antibody; and the like. For each sample of RNA, one can generate labeled oligos with the same labels. Alternatively, one can use different labels for each physiological source, which provides for additional assay configuration possibilities, as described in greater detail below.

In a variation of the above embodiment, where desired one can generate labeled RNA instead of labeled first strand cDNA. In this embodiment, first strand cDNA synthesis is carried out in the presence of unlabeled dNTPs and unlabeled gene specific primers. However, the primers are optionally modified to comprise a promotor for an RNA polymerase, such as T7 RNA polymerase, T3 RNA polymerase, SP6 RNA polymerase, and the like. In this embodiment, following first strand cDNA synthesis, the resultant single stranded cDNA is then converted to double stranded CDNA, where the resultant double stranded CDNA comprises the anchor sequence comprising the promoter region. Conversion of the mRNA:cDNA hybrid following first strand synthesis can be carried out as described in Okayama & Berg, Mol. Cell. Biol. (1982) 2:161–170, and Gubler & Hoffman, Gene (1983) 25: 253–269, where briefly the RNA is digested with a ribonuclease, such as E.coli RNase H, followed by repair synthesis using a DNA polymerase like DNA polymerase I, etc., and E.coli DNA ligase. One may also employ the modification of this basic method described in Wu, R, ed., Methods in Enzymology (1987), vol. 153 (Academic Press). Next, the double stranded cDNA is contacted with RNA polymerase and dNTPs, including labeled dNTPs, to produce linearly amplified labeled ribonucleic acids. For cDNA lacking the anchor sequence comprising a promoter region, a polymerase that does not need a promoter region but instead can initiate RNA strand synthesis randomly from cDNA, such as core fragment of E.Coli RNA polymerase, may be employed.

In another embodiment of the subject invention, the labeled nucleic acid generation step comprises one or more enzymatic amplification steps in which multiple DNA copies of the initial RNAs present in the sample are produced, from which multiple copies of the initial RNA or multiple copies of antisense RNA (aRNA) may be produced, using the polymerase chain reaction, as described in U.S. Pat. No. 4,683,195, the disclosure of which is herein incorporated by reference, in which repeated cycles of double stranded DNA denaturation, oligonucleotide primer annealing and DNA polymerase primer extension are performed, where the PCR conditions may be modified as described in U.S. Pat No. 5,436,149, the disclosure of which is herein incorporated by reference.

In one embodiment involving enzymatic amplification, the set of gene-specific primers are employed in the generation of the first strand cDNA, followed by amplification of the first strand cDNA to produce amplified numbers of labeled cDNA. In this embodiment, as a set of gene-specific primers is employed in the first strand synthesis step, only a representative proportion of the total RNA in the sample is amplified during the subsequent amplification steps.

Amplification of the first strand cDNA can be conveniently achieved by using a CAPswitch™ oligonucleotide as described in U.S. patent application Ser. No. 08/582,562, the disclosure of which is herein incorporated by reference. Briefly, the CAPswitch™ technology uses a unique CAPswitch™ oligonucleotide in the first strand cDNA synthesis followed by PCR amplification in the second step to generate a high yield of ds cDNA. When included in the first-strand cDNA synthesis reaction mixture, the CAPswitch™ oligonucleotide serves as a short extended template. When reverse transcriptase stops at the 5' end of the mRNA template in the course of first strand cDNA synthesis it switches templates and continues DNA synthesis to the end of the CAPswitch™ oligonucleotide. The resulting ss cDNA incorporates at the 3' end, sequence which is complimentary to complete 5' end of the mRNA and the CAPswitch™ oligonucleotide sequence.

Of particular interest as the CAPswitch™ oligonucleotide are oligonucleotides having the following formula:

5'-dN1-dN2- . . . dNm-rN1-rN2 . . . rNn-3' wherein:

dN represents a deoxyribonucleotide selected from among dAMP, dCMP, dGMP and dTMP;

m represents an integer 0 and above, preferably from 10 to 50;

rN represents a ribonucleotide selected from the group consisting of AMP, CMP, GMP and UMP, preferably GMP; and n represents an integer 0 and above, preferably from 3 to 7.

The structure of the CAPswitch™ oligonucleotide may be modified in a number of ways, such as by replacement of 1 to 10 nucleotides with nucleotide analogs, incorporation of terminator nucleotides, such as 3'-amino NMP, 3'-phosphate NMP and the like, or non-natural nucleotides which can improve efficiency of the template switching reaction but still retain the main function of the CAPswitch™ oligonucleotide i.e. CAP-depended extension of full-length cDNA by reverse transcriptase using CAPswitch™ oligonucleotide as a template.

In using the CAPswitch™ oligonucleotide, first strand cDNA synthesis is carried out in the presence of a set of gene specific primers and a CAPswitch™ oligonucleotide, where the gene specific primers have been modified to comprise an arbitrary anchor sequence at their 5' ends. The first strand cDNA is then combined with primer sequences complementary to: (a) all or a portion of the CAPswitch™ oligonucleotide and (b) the arbitrary anchor sequence of the gene specific primers and additional PCR reagents, such as dNTPs, DNA polymerase, and the like, under conditions sufficient to amplify the first strand cDNA. Conveniently, PCR is carried out in the presence of labeled dNTPs such that the resultant, amplified cDNA is labeled and serves as the labeled or target nucleic acid. Labeled nucleic acid can also be produced by carrying out PCR in the presence of labeled primers, where either or both the CAPswitch™ oligonucleotide complementary primer and anchor sequence complementary primer may be labeled. In yet an alternative embodiment, instead of producing labeled amplified cDNA, one may generate labeled RNA from the amplified ds cDNA, e.g by using an RNA polymerase such as E.coli RNA polymerase, or other RNA polymerases requiring promoter sequences, where such sequences may be incorporated into the arbitrary anchor sequence.

Instead of using the set of gene specific primers in the first strand cDNA synthesis step followed by subsequent amplification of only a representative fraction of the total number of distinct RNA species in the sample, one may also amplify all of the RNAs in the sample and use the set of gene specific primers to generate labeled nucleic acid following amplification. This embodiment may find use in situations where the RNA of interest to be amplified is known or postulated to be in small amounts in the sample.

In this embodiment, first strand synthesis is carried out using: (a) an oligo dT primer that usually comprises an arbitrary anchor sequence at its 5' end and (b) a CAPswitch™ oligonucleotide. During first strand synthesis the oligo(dT) anneals to the polyA tail of the mRNA in the sample and synthesis extends beyond the 3' end of the RNA to include the CAPswitch™ oligonucleotide, yielding a first strand cDNA comprising an arbitrary sequence at its 5' end and a region complementary to the CAPswitch™ oligonucleotide at its 3' end. The length of the dT primer will typically range from 15 to 30 nts, while the arbitrary anchor sequence or portion of the primer will typically range from 15 to 25 nt in length.

Following first strand synthesis, the cDNA is amplified by combining the first strand CDNA with primers that correspond at least partially to the anchor sequence and the CAPswitch™ oligonucleotide under conditions sufficient to produce an amplified amount of the cDNA. Labeled nucleic acid is then produced by contacting the resultant amplified cDNA with a set of gene specific primers, a polymerase and dNTPs, where at least one of the gene specific primers and dNTPs are labeled.

The labeled nucleic acids produced above provide a representation of the total RNA profile of the particular source from which the labeled nucleic acids are generated. Accordingly, the labeled nucleic acids find use in comparing the characteristic RNA profiles of different physiological sources and identifying differences in the RNA profiles between different physiological source. Comparison of the RNA profiles of two or more physiological sources finds particular use in methods of identifying differential gene expression in two physiological samples, such as cells or tissues derived from the same or different individual organisms, where the tissues may represent different diseased or normal states, different organ or tissue types, etc.

The labeled nucleic acids of the plurality of physiological sources may be compared in a number of different ways. Thus, one may compare the labeled nucleic acids from each source by separately resolving the labeled nucleic acids from each source under substantially identical electrophoretic conditions to yield an electrophoretic pattern of resolved bands for each of the different populations of labeled nucleic acids. The resultant electrophoretic patterns can then be resolved to identify differences between the labeled nucleic acid populations, which differences can then be attributed to differences in the RNA profiles of the each of the physiological sources, where such differences can, in turn, be attributed to difference in gene expression. See Liang & Pardee, Science (1992) 257: 967. Conveniently, electrophoretic separation under identical electrophoretic conditions can be achieved by running the labeled nucleic acids derived from each physiological source of interest in separate, side by side lanes on a slab gel. Automated electrophoretic machines as described in U.S. Pat. Nos. 5,410,412; 5,275,710; 5,217,591; and 5,104,512, the disclosures of which are herein incorporated by references, may be employed to resolve the labeled nucleic acids. In a modification of the above, where each set of labeled nucleic acids or targets of each physiological source has been labeled with a distinct and distinguishable label, the opportunity arises to resolve the nucleic acids in the same electrophoretic medium, e.g. the same column or in the same lane of a slab, thereby ensuring that the nucleic acids are resolved under identical electrophoretic conditions.

Alternatively, one may hybridize the labeled nucleic acids to predefined arrays of probe polymeric molecules stably associated with the surface of a substrate, where the probe polymeric molecules are capable of sequence specific base pair hybridization with complementary labeled target nucleic acids. A variety of different arrays which may be used are known in the art. The polymeric or probe molecules of the arrays may be oligonucleotides or hybridizing analogues or mimetics thereof, including: nucleic acids in which the phosphodiester linkage has been replaced with a substitute linkage, such as phophorothioate, methylimino, methylphosphonate, phosphoramidate, guanidine and the like; nucleic acids in which the ribose subunit has been substituted, e.g. hexose phosphodiester; peptide nucleic acids; and the like. The length of the probes will generally range from 10 to 1000 nts, where oligonucleotide probes usually range from 15 to 150 nts and more usually from 15 to 100 nts in length, and polynucleotide probes usually range in length from 150 to 1000 nts, where the polynucleotide probes may be single or double stranded, usually single stranded, and may be PCR fragments amplified from cDNA. The probe molecules on the surface of the substrates will preferably correspond to known genes of the physiological source being analyzed so that positive hybridization events may be correlated to expression of a particular gene in the physiological source. Of particular interest are arrays of probes which correspond to a particular subset of the total genes expressed by a particular physiological source. For example, for analysis of human physiological sources, preferably the arrays of probes will correspond to a particular subset of all the expressed human genes, such as those genes associated with cell-cell communication, cancer related genes, etc. The arrays of probes may have sequences that are complementary to the template and/or non-template strands of the gene to which they correspond, depending on the nature of the labeled target nucleic acid to which they are to hybridize.

The substrates with which the probe molecules are stably associated may be fabricated from a variety of materials, including plastics, ceramics, metals, gels, membranes, glasses, and the like.

A variety of different methodologies have been developed for producing arrays of probes stably associated to the surface of a substrate. Representative methodologies include spotting methods, in which probes are immobilized or spotted on the surface of substrates as described in WO 95/35505 the disclosure of which is herein incorporated by reference, and methods in which the probes are synthesized or grown on the surface of the substrates, such as EP 0 373 203 B1 and U.S. Pat. No. 5,445,934, the disclosures of which are herein incorporated by reference. Arrays of probes spotted onto nylon membranes are described in Lennon & Lerach, Trends in Genetics (1991) 7:314–317; Gress et al., Mammalian Genome (1992) 3:609–619; Meier-Ewert et al., Nature (1993) 361:375–376; Nguyen et al., Genomics (1995) 29:207–216; Zhao et al., Gene (1995) 156:207–213; Takahashi et al., Gene (1995) 164:219–217; Milosavlijevic et al., Genome Research (1996) 6:132–141; Pietu e al., Genome Research (1996) 6:492–503; and Drmanac, Science (1993) 260:1649–1652. Arrays of probes spotted onto the surface of modified microscope glass slides are described in Shena et al., Science (1995) 270: 467–470 and Shalon et al., Genome Research (1996) 6: 639–645. Arrays in which the probes have been grown on the surface of a substrate are described in Lockhart et al., Nature Biotechnology (1996) 14:1675.

Of particular interest for use in the analysis of differential gene expression in human physiological sources are the arrays of subsets human cDNAs sold under the trademark Atlas™ by Clontech and described in CLONTECHniques (April, 1997) 12:4–7.

In analyzing the differences in the population of labeled nucleic acids generated from two or more physiological sources using the arrays described above, each population of labeled nucleic acids are separately contacted to identical probe arrays under conditions of hybridization, preferably under stringent hybridization conditions, such that labeled nucleic acids hybridize to their complementary probes on the substrate surface. Suitable hybridization conditions are well known to those of skill in the art and reviewed in Maniatis et al, supra and WO 95/21944.

As with the electrophoretic analysis, where all of the target sequences comprise the same label, different arrays will be employed for each physiological source (where different could include using the same array at different times). Alternatively, where the labels of the targets are different and distinguishable for each of the different physiological sources being assayed, the opportunity arises to use the same array at the same time for each of the different target populations.

In one preferred embodiment of assays using arrays, the number of gene specific primers used to generate the target will be chosen in view of the number of distinct probes present on the surface of the substrate of the array. In such instances, the number of gene specific primers in the set will not vary by more than 10 fold from the number of distinct probes, usually by not more than 5 fold and more usually by not more than 2 fold from the number of distinct probes in the array.

Following hybridization, non-hybridized labeled nucleic acid is removed from the support surface, conveniently by washing, generating a pattern of hybridized nucleic acid on the substrate surface. A variety of wash solutions are known to those of skill in the art and may be used.

The resultant hybridization patterns of labeled nucleic acids may be visualized or detected in a variety of ways, with the particular manner of detection being chosen based on the particular label of the nucleic acid, where representative detection means include scintillation counting, autoradiography, fluorescence measurement, colorimetric measurement, light emission measurement and the like.

Following detection or visualization, the hybridization patterns may be compared to identify differences between the patterns. Where arrays in which each of the different probes corresponds to a known gene are employed, any discrepancies can be related to a differential expression of a particular gene in the physiological sources being compared.

The subject methods find use in, among other applications, differential gene expression assays. Thus, one may use the subject methods in the differential expression analysis of: (a) diseased and normal tissue, e.g. neoplastic and normal tissue, (b) different tissue or subtissue types; and the like.

Also provided are kits for use in carrying out the subject methods, e.g. generating populations of labeled nucleic acids, performing differential gene expression analysis and the like. The kits according to the subject invention include at least the set of gene specific primers that are employed to generate the labeled oligonucleotides. Of particular interest are kits comprising a set of primers selected from the primers identified as SEQ ID NO: 01–1372 in application Ser. No. 08/859,008 filed May 21, 1997, the disclosure of which is herein incorporated by reference, where in these kits of particular interest, at least twenty, usually at least 50 and more usually at least 100 of the gene specific primers in the kit will be selected from this group of primers identified as SEQ ID NO: 01–1372. Also of interest are kits comprising those gene specific primers corresponding to those genes (and specifilc capable of producing target capable of hybridizin to those specific regions of the genes) as listed in the following copending patent applications, the disclosures of which are herein incorporated by reference: U.S. application Ser. No. 09/221,480 entitled Apoptosis Array; U.S. application Ser. No. 09/222,432 entitled Cancer Array; U.S. application Ser. No. 09/222,437 entitled Cell Cycle Array; U.S. application Ser. No. 09/222,437 entitled Cell Interaction Array; U.S. application Ser. No. 09/222,251 entitled Cytokine Receptor Array; U.S. application Ser. No. 09/221,481 entitled Human Array; U.S. application Ser. No. 09/222,256 entitled Human Stress Array; U.S. application Ser. No. 09/222,248 entitled Mouse Array; and U.S. application Ser. No. 09/222,253 entitled Oncogene/Tumor Suppressor Array. The kits may further comprise one or more additional reagents employed in the various methods, such as additional non-gene specific primers sequences, such as SEQ ID NO: 1373 to 1375 of application Ser. No. 08/859,008 filed May 21, 1997, the disclosure of which is herein incorporated by reference, dNTPs and/or rNTPs, which may be either premixed or separate, one or more uniquely labeled dNTPs and/or rNTPs, such as biotinylated or Cy3 or Cy5 tagged dNTPs, enzymes, such as reverse transcriptases, DNA polymerases, and the like, various buffer mediums, e.g. hybridization and washing buffers, prefabricated probe arrays, labeled probe purification reagents and components, like spin columns, etc., signal generation and detection reagents, e.g. streptavidin-alkaline phosphatase conjugate, chemifluorescent or chemiluminescent substrate, and the like.

The following examples are offered by way of illustration and not by way of limitation. Except where noted otherwise, all percentages are by weight and all solvent mixture proportions are by volume.

EXPERIMENTAL

EXAMPLE 1

Generation of $^{32}$P-labeled Oligonucleotides During First Strand cDNA Synthesis Step A. cDNA Synthesis/Labeling Procedure 1 µg of polyA+RNA was converted into $^{32}$P-labeled first-strand cDNA as follows. A sufficient volume of master mix for all labeling reactions and 1 extra reaction was prepared as follows to ensure sufficient volume. For each 10-µl labeling reaction, the following reagents were mixed:

| | |
|---|---|
| 2 µl | 5X First-strand buffer (250 µM Tris-HCl pH 8.3; 375 mM KCl; 15 mM MgCl$_2$) |
| 1 µl | 10XdNTP mix (500 µM dGTP, 500 µM dCTP, 500 µM dTTP, 5 µM dATP) |
| 4 µl | [α-$^{32}$P]dATP (Amersham, 3000 Ci/mmol, 10 mCi/ml) |
| 1 µl | MMLV reverse transcriptase (Amersham, 200 units/µl) |
| 8 µl | Final volume |

Next, the following reagents were combined in a 0.5-ml PCR test tube:

1 µg((1–2 µl) polyA+RNA sample

1 µl 10×gene-specific primers mix (0.2 µM of each oligonucleotide ID No. 2,4,6,8,10,12, . . . 1372 as listed in application Ser. No. 08/859,008 filed May 21, 1997, the disclosure of which is herein incorporated by reference)

As a control, in separate test tube were mixed 1 µg of polyA+RNA sample with 1 µl of oligo dT primer (CDS1, ID No.1373 as listed in application Ser. No. 08/859,008 filed May 21, 1997, the disclosure of which is herein incorporated by reference).

For each tube ddH$_2$O was added to a final volume of 3 ul and the contents were mixed and spun briefly in a microcentrifuge. The tubes were then incubated in a preheated PCR thermocycler at 70° C. for 2 min. The temperature in thermocycle was reduced down to 50° C. and the tube contents were incubated for 2 min. 8 µl of master mix as prepared above were added to each reaction test tube. The contents of the test tubes were then mixed by gentle pipetting. The tubes were then incubated in a PCR thermocycler for 20 min at 50° C. The reaction was then stopped by adding 1 µl of 10×termination mix (0.1 M EDTA, 1 mg/ml glycogen).

Step B. Column Chromatography

The $^{32}$P-labeled cDNAs were separated from unincorporated $^{32}$P-labeled nucleotides and small (<0.1-kb) cDNA fragments using the following procedure for each test tube. A CHROMA SPIN-200 column (CLONTECH, Palo Alto, Calif.) was placed into a 1.5-ml microcentrifuge tube, the water was allowed to drain through the column by gravity flow until the surface of the gel beads emerged in the column matrix. The sample was then applied to the center of the gel bed's flat surface and allowed to be fully absorbed into the resin bed. 25 µl of ddH$_2$O were then applied and allowed to completely drain out of the column. 200 µl of ddH$_2$O were then applied and allowed to completely drain out of the column until there was no liquid left above the resin bed. The column was then transferred to a clean 1.5-ml microcentrifuge tube.

To collect the first fraction, 100 µl of ddH$_2$O were added to the column and allowed to completely drain out of the column. The second, third and fourth fractions were collected in analogous fashion. The tubes with fractions 1–4 were then placed in scintillation counter empty vials, and Cerenkov counts for each fraction were obtained in the tritium channel. The fractions which showed the highest Cerenkov counts were pooled.

EXAMPLE 2

Generation of Cy3-labeled Hybridization Polynucleotide Target from Total RNA Using Preamplification Step CAPswitch™ technology can be effectively used for construction cDNA libraries using as a template 10–100 ng of total RNA. Any conventional procedure well known in art can be used to purify this small amount of total RNA from 10–50 mg of "difficult" cells or tissues, like human biopsy tissues, pathogenic microorganisms, tissues at different developmental stages etc.

Step A. First-Strand Synthesis—Template Switching 10 pmol of cDNA synthesis primer (oligo dT primer)
5'-d(TCTAGAATTCAGCGGCCGC(T)30VN)-3'CDS1 (ID No. 1373)
(where V=G or A or C; N=G or A or T or C)
and 10 pmol of CAPswitch™ oligonucleotide (CSO1):
5'-d(CTAATACGACTCACTATAGGGC)r(GGG)-3'CSO1 (ID No. 1374)
were annealed to 100 ng of human skeletal muscle Total RNA (CLONTECH), in a volume of 5 ml of deionized water, by heating the mixture for 2 min at 70° C., followed by cooling on ice for 2 min. First-strand cDNA synthesis was then initiated by mixing the annealed primer-RNA with 200 units of M-MLVreverse transcriptase (Amersham) in a final volume of 10 µl, containing 50 mM Tris-HCl (pH 8.3 at 22° C.), 75 mM KCl, 6 mM MgCl2, 1 mM DTT, 1 mM of each dATP, dGTP, dCTP and dTTP. The first-strand cDNA synthesis-template switching reaction was incubated at 42° C. for 1.5 hr in an air incubator and then cooled on ice.

Step B. Generation of Full-length cDNA by PCR

PCR amplification of full-length cDNA was performed using the Advantage KlenTaq Polymerase Mix (CLONTECH). Amplification was conducted in a 100-µl volume containing 2 µl of first-strand cDNA, 40 mM Tricine-KOH (pH 9.2 at 22°C.), 3.5 mM Mg(OAc)$_2$, 10 mM KOAc, 75 µg/ml BSA, 200 µM of each dATP, dGTP, dCTP and dTTP, 0.2 µM of each CAPswitch™ primer (CSP1, ID No. 1375 as identified in application Ser. No. 08/859,998, now U.S. Pat. No. 5,994,076 filed May 21, 1997, the disclosure of which is herein incorporated by reference) and CDS1 primer and 2 µl of KlenTaq Polymerase mix. Temperature parameters of the PCR reactions were as follows: 1 min at 95° C. followed by 20–22 cycles of 95° C. for 15 sec and 68° C. for 5 min; followed by a 10-min final extension at 68° C. PCR products were examined on 1.2% agarose/EtBr gels in 1×TBE buffer. As a DNA size marker, a 1 Kb DNA ladder was used. ds cDNA was then precipitated by addition of a half volume of 4M ammonium acetate (about 35 ml) and 3.7 volumes of 95% ethanol (about 260 ml). After vortexing, the tube was immediately centrifuged at 14,000 r.p.m. in a microcentrifuge for 20 min. The pellet was washed with 80% ethanol without vortexing, centrifuged as above for 10 min, air dried, and dissolved in 10 µl of deionized water. Yield of ds cDNA after amplification step is about 5 µg.

Step C. Labeling of cDNA by Cy3-dCTP.

5 µl of ds cDNA (2.5 µg) generated after amplification step were mixed with 4 µl of a mixture of 686 antisense gene-specific primers (0.1 µM each; ID No. 2,4,6,8,10,12, . . . 1372 as listed in application Ser. No. 08/859,008 filed May 21, 1997, the disclosure of which is herein incorporated by reference) in a 0.5-ml PCR test tube, boiled at 100°C. for 5 min and quickly cooled in the ice. To the denatured DNA/gene-specific primer mix was added 5 µl of 5×reaction buffer (250 mM Tris-HCl, pH 7.5, 50 mM MgCl$_2$, 5 mM DTT, 250 µg/ml BSA), 10 µl 2.5×dNTP mix (500 µM each of dATP, dGTP and dTTP, 350 µM dCTP and 150 µM Cy3-dCTP (Amersham)), 0.5 µl of [α-$^{32}$P]dCTP (Amersham, 3000 Ci/mmol, 10 mCi/ml) and 0.5 µl of Advantage KlenTaq mix (Clontech). The mixture was incubated at 68° C. for 10 min and the reaction stopped by adding 1 µl of 10×termination mix (0.1 M EDTA, 1 mg/ml glycogen).

Step D. Column Chromatography

To purify the Cy3-labeled cDNAs from unincorporated Cy3-labeled nucleotides and small (<0.1-kb) cDNA fragments, a CHROMA SPIN-200 column (CLONTECH) was placed into a 1.5-ml microcentrifuge tube, water was drained from the column and the sample was applied to the center of the gel bed's flat surface and allowed to be fully absorbed into the resin bed. 25 µl of ddH$_2$O were applied and allowed to completely drain out of the column. 200 µl of ddH$_2$O were applied and the buffer was allowed to completely drain out of the column until there was no liquid left above the resin bed. The column was then transferred to a clean 1.5-ml microcentrifuge tube.

To collect the first fraction, 100 µl of ddH$_2$O was added to the column and allowed to completely drain out of the column. The second, third and fourth fractions were collected in analogous fashion. The tubes with fractions 1–4 were placed in scintillation counter empty vials, and Cerenkov counts were obtained for each fraction in the tritium channel. The fractions (usually fractions 2–3) which showed the highest Cerenkov counts were pooled, and other fractions were discarded.

EXAMPLE 3

Generation of cDNA Array Probe Immobilized on Nylon Membrane 686 cDNA fragments corresponding 686 different human genes were amplified from quick-clone cDNA (CLONTECH) in 686 separate test tubes using a combination of sense and antisense gene-specific primers: SEQ ID Nos. 1+2, 3+4, 5+6, 7+8, . . . 1371+1372 as listed in application Ser. No. 08/859,998, now U.S. Pat. No. 5,994, 076 filed May 21, 1997, the disclosure of which is herein incorporated by reference. Amplification was conducted in a 100-µl volume containing 2 µl of mixture of 10 Quick-clone cDNA from placenta, brain, liver, lung, leukocytes, spleen, skeletal muscle, testis, kidney and ovary (CLONTECH), 40 mM Tricine-KOH (pH 9.2 at 22° C.), 3.5 mM Mg(OAc)$_2$, 10 mM KOAc, 75 µg/ml BSA, 200 µM of each dATP, dGTP, dCTP and dTTP, 0.2 µM of each sense and antisense gene-specific primers and 2 µl of KlenTaq Polymerase mix. Temperature parameters of the PCR reactions were as follows: 1 min at 95° C. followed by 20–35 cycles of 95° C. for 15 sec and 68° C. for 2 min; followed by a 10-min final extension at 68° C. PCR products were examined on 1.2% agarose/EtBr gels in 1×TBE buffer. As a DNA size marker we used a 1 Kb DNA Ladder. ds cDNA was then precipitated by addition of a half volume of 4M ammonium acetate (about 35 ul) and 3.7 volumes of 95% ethanol (about 260 ul). After vortexing, the tube was immediately centrifuged at 14,000 r.p.m. in a microcentrifuge for 20 min. The pellet was washed with 80% ethanol without vortexing, centrifuged as above for 10 min, air dried, and dissolved in 10 µl of deionized water. Yield of ds cDNA after amplification step was about 5 µg. The ds cDNA was denatured by adding 1 µl of 10×denaturing solution (1 M NaOH, 10 mM EDTA) and incubating at 65° C. for 20 min. All cDNA probes were transferred in 384-well plate and loaded on positively charged nylon membrane (Schleher & Schull) using 384 pin tool and Biomek 2000 (Beckman) robot.

EXAMPLE 4

Hybridization $^{32}$P-labeled cDNA Target with cDNA ARRAY

A solution of ExpressHyb™ (CLONTECH) and sheared salmon testes DNA (Sigma) was prepared by prewarming 15 ml of ExpressHyb™ at 50–60° C., heating 1.5 mg of sheared salmon testes DNA at 95–100° C. for 5 min followed by chilling quickly on ice, and combining the resultant heat-denatured sheared salmon testes DNA with the prewarmed ExpressHyb™.

A cDNA ARRAY (Atlas™ Human cDNA Expression Array, Clontech, Palo Alto, Calif.) was then placed in a hybridization bottle and 10 ml of the solution prepared above was added to the bottle. Prehybridization was performed for 30 min with continuous agitation at 72° C. Labeled cDNA probe (Example 1, about 200 ul, total about 2–5×10$^6$ cpm) with ¹⁄₁₀th of the total volume (about 22 ul) of 10×denaturing solution (1 M NaOH, 10 mM EDTA) was mixed and incubated at 65° C. for 20 min. 5 µl (1 µg/ul) of human Cot-1 DNA was then added, and an equal volume (about 225 µl) of 2×Neutralizing solution (1M NaHPO4, pH 7.0) was added and incubation continued at 65° C. for 10 min. The mixtures were then combined and thoroughly mixed.

The prehybridization solution was then replaced with the solution comprising the labeled oligonucleotide as prepared above and allowed to hybridize overnight with continuous agitation at 65° C. Following hybridization, the hybridization solution was carefully removed and discarded, replaced with 200 ml of Wash Solution 1(2×SSC, 1% SDS). The ARRAY was washed for 20 min with continuous agitation at 65° C. Washing was repeated four times.

Two additional 20-min washes were then performed in 200 ml of prewarmed Wash Solution 2 (0.1×SSC, 0.5% SDS) with continuous agitation at 65° C. Using forceps, cDNA ARRAY was removed from the container and excess wash solution was removed by shaking.

The damp membrane was immediately wrapped in plastic wrap, mounted on Whatman paper (3 mm Chr). Exposed to x-ray film at −70° C. with an intensifying screen.

EXAMPLE 5

Comparison Between Using Sets of Gene Specific Primers and Oligo dT

FIG. 1 of application Ser. No. 08/859,998, now U.S. Pat. No. 5,994,076 filed May 21, 1997 (the disclosure of which is herein incorporated by reference) illustrates the effectiveness of using $^{32}$P-labelled polynucleotide target generated using sets of gene specific primers according to the subject invention in hybridization with a cDNA array of 588 probes immobilized on a nylon membrane.

$^{32}$P-labeled cDNA target were synthesized by M-MLV reverse transcriptase from a mixture 588 antisense gene-specific primers (B) or oligo dT(A) using placenta polyA+ RNA as a template as described in Example 1. Primer extension products generated by reverse transcription were purified by gel filtration as described in Example 1 and hybridized separately with two cDNA arrays comprising 588 human genes under identical conditions as described in Example 4. The arrows in pattern B indicate the position of signals which can be detected by using cDNA target generated using the set of gene specific primers but can not be detected by using conventional target generated with oligo dT primers (pattern A). The level of non-specific background detected as signal generated by membrane alone outside of the regions with immobilized probes generated by target generated using oligo dT primers was significantly higher (filter A) in comparison with the background generated by the target generated by using the sets of gene specific primers (filter B).

It is evident from the above results and discussion that the subject invention provides for improved methods of assaying for differential expression. With the subject methods, specificity and efficiency are improved, as compared to previous methods of differential gene expression analysis in which sets of gene specific primers are not employed to generate labeled nucleic acids.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

SEQUENCE LISTING (1375 sequences)

SEQ ID NO: 1 - DNA, 26 bp; single-stranded, linear
  oligonucleotide primer
caactgcccatctgaggatgtagtcg

SEQ ID NO: 2 - DNA, 27 bp; single-stranded, linear
  oligonucleotide primer
ttgtcgctcacggtaagttcagtctgg

SEQ ID NO: 3 - DNA, 28 bp; single-stranded, linear
  oligonucleotide primer
atccaaaagagtgtggagaccatcaagg

SEQ ID NO: 4 - DNA, 28 bp; single-stranded, linear
  oligonucleotide primer
ttttcgcttccctgttttagctgctggc

SEQ ID NO: 5 - DNA, 26 bp; single-stranded, linear
  oligonucleotide primer
taggtatatctttggacttcctcccc

SEQ ID NO: 6 - DNA, 27 bp; single-stranded, linear
  oligonucleotide primer
aagaaattgcctcaacttgcgagcagc

SEQ ID NO: 7 - DNA, 26 bp; single-stranded, linear
  oligonucleotide primer
gctcctggcaaaaggtcagagtctgg

SEQ ID NO: 8 - DNA, 26 bp; single-stranded, linear
  oligonucleotide primer
ggggctggtgcattttcggttgttgc

SEQ ID NO: 9 - DNA, 26 bp; single-stranded, linear
  oligonucleotide primer
ggtcacactggtagaacgtaaccacg

SEQ ID NO: 10 - DNA, 26 bp; single-stranded, linear
  oligonucleotide primer
ctcgaactcctgggctcaagcaatcc

SEQ ID NO: 11 - DNA, 29 bp; single-stranded, linear
  oligonucleotide primer
caggatgctcacatttaagttttacatgc

SEQ ID NO: 12 - DNA, 28 bp; single-stranded, linear
  oligonucleotide primer
atccatctgttcagaaattctacaatgg

SEQ ID NO: 13 - DNA, 26 bp; single-stranded, linear
  oligonucleotide primer
atgaatcggcaacgagatggaggtgg

SEQ ID NO: 14 - DNA, 25 bp; single-stranded, linear
  oligonucleotide primer
ggagcaggagttacgttctctgggc

SEQ ID NO: 15 - DNA, 26 bp; single-stranded, linear
  oligonucleotide primer
ggcatacctcaacgccaataagttcg

SEQ ID NO: 16 - DNA, 26 bp; single-stranded, linear
  oligonucleotide primer
cttgttctcctcgctgtagtagaagg

SEQ ID NO: 17 - DNA, 25 bp; single-stranded, linear
  oligonucleotide primer
cagccgtggcatcgttgaggagtgc

SEQ ID NO: 18 - DNA, 26 bp; single-stranded, linear
  oligonucleotide primer
tggactgcttccaggtgtcatattgg

SEQ ID NO: 19 - DNA, 26 bp; single-stranded, linear
  oligonucleotide primer
ggctgccaagctgaaattgaatgagg

SEQ ID NO: 20 - DNA, 26 bp; single-stranded, linear
  oligonucleotide primer
aatccagggtgctacttgttaggagg

SEQ ID NO: 21 - DNA, 26 bp; single-stranded, linear
  oligonucleotide primer
gtccaccatgaatgagtacattgagc

SEQ ID NO: 22 - DNA, 26 bp; single-stranded, linear
  oligonucleotide primer
tgtagcagaactcgattaaggcaacc

SEQ ID NO: 23 - DNA, 23 bp; single-stranded, linear
  oligonucleotide primer
tcacttctccagccaagtagccc

SEQ ID NO: 24 - DNA, 24 bp; single-stranded, linear
  oligonucleotide primer
aggatgccagggtagggattcagc

SEQ ID NO: 25 - DNA, 22 bp; single-stranded, linear
  oligonucleotide primer
gccactacactccagcctgagc

SEQ ID NO: 26 - DNA, 24 bp; single-stranded, linear
  oligonucleotide primer
ctgccctgtgatgccaaggaagcc

SEQ ID NO: 27 - DNA, 28 bp; single-stranded, linear
  oligonucleotide primer
ggagatatgttgtgaaagaagcagtagc

SEQ ID NO: 28 - DNA, 28 bp; single-stranded, linear
  oligonucleotide primer
gaagtgcatttccaatagtcagctaagg

SEQ ID NO: 29 - DNA, 21 bp; single-stranded, linear
  oligonucleotide primer
gcacacgcatgacaagacggc

SEQ ID NO: 30 - DNA, 23 bp; single-stranded, linear
  oligonucleotide primer
aggcaggctatgctgagaggtcc

SEQ ID NO: 31 - DNA, 24 bp; single-stranded, linear
  oligonucleotide primer
ggctctccagaacatcatccctgc

SEQ ID NO: 32 - DNA, 24 bp; single-stranded, linear
  oligonucleotide primer
gggtgtcgctgttgaagtcagagg

SEQ ID NO: 33 - DNA, 26 bp; single-stranded, linear
  oligonucleotide primer
gggactttgtatagaaggtttggggg

SEQ ID NO: 34 - DNA, 26 bp; single-stranded, linear
  oligonucleotide primer
tacgtgtgcgtaacacccgaaccagg

SEQ ID NO: 35 - DNA, 27 bp; single-stranded, linear
  oligonucleotide primer
tcataacaattttaggaggaccagagc

SEQ ID NO: 36 - DNA, 28 bp; single-stranded, linear
  oligonucleotide primer
catttcgtgctttgccttcatcttgagg

SEQ ID NO: 37 - DNA, 26 bp; single-stranded, linear
  oligonucleotide primer
cttcttcgacacatgggataacgagg

SEQ ID NO: 38 - DNA, 26 bp; single-stranded, linear
  oligonucleotide primer
gagaggtgctgatgtaccagttgggg

SEQ ID NO: 39 - DNA, 28 bp; single-stranded, linear
  oligonucleotide primer
gaggaaactgacgttctatctgaaaacc

SEQ ID NO: 40 - DNA, 28 bp; single-stranded, linear
  oligonucleotide primer
tctgatgccgcaggaaaaggtgaaatgc

SEQ ID NO: 41 - DNA, 24 bp; single-stranded, linear
  oligonucleotide primer
gaccgtaacagacatctttgctgc

SEQ ID NO: 42 - DNA, 26 bp; single-stranded, linear
  oligonucleotide primer
gtactctggttggcttccttcacagg

SEQ ID NO: 43 - DNA, 26 bp; single-stranded, linear
  oligonucleotide primer
ggagaagattccaaagatgtagccgc

SEQ ID NO: 44 - DNA, 25 bp; single-stranded, linear
  oligonucleotide primer
ctggcatttgtggttgggtcagggg

SEQ ID NO: 45 - DNA, 24 bp; single-stranded, linear
  oligonucleotide primer
tcacccacaccatcagccgcatcg

SEQ ID NO: 46 - DNA, 24 bp; single-stranded, linear
  oligonucleotide primer
gggaaggttggatgttcgtcctcc

SEQ ID NO: 47 - DNA, 24 bp; single-stranded, linear
  oligonucleotide primer
tcttgcccacagcaccctcaaacc

SEQ ID NO: 48 - DNA, 23 bp; single-stranded, linear
  oligonucleotide primer
aggctttcccagagaagaccacc

SEQ ID NO: 49 - DNA, 23 bp; single-stranded, linear
  oligonucleotide primer
atgctggctctggaaacctcacc

SEQ ID NO: 50 - DNA, 24 bp; single-stranded, linear
  oligonucleotide primer
tcccgcttcgagacctttgcctcc

SEQ ID NO: 51 - DNA, 24 bp; single-stranded, linear
  oligonucleotide primer
gcaagtcagggttggagcagtagc

SEQ ID NO: 52 - DNA, 24 bp; single-stranded, linear
  oligonucleotide primer
gcaagggctgggagagcaattccg

SEQ ID NO: 53 - DNA, 26 bp; single-stranded, linear
  oligonucleotide primer
ggacggcttttacttaaacgccaagg

SEQ ID NO: 54 - DNA, 26 bp; single-stranded, linear
  oligonucleotide primer
atcttccctagttacccaggttcagc

SEQ ID NO: 55 - DNA, 26 bp; single-stranded, linear
  oligonucleotide primer
tttcagagccatgaggatgcttctgc

SEQ ID NO: 56 - DNA, 28 bp; single-stranded, linear
  oligonucleotide primer
agtttgactctccagtgtgcctattccc

SEQ ID NO: 57 - DNA, 27 bp; single-stranded, linear
  oligonucleotide primer
tttcagacaagattcatctagcactgg

SEQ ID NO: 58 - DNA, 27 bp; single-stranded, linear
  oligonucleotide primer
acattagccatcagtcacttaaacagc

SEQ ID NO: 59 - DNA, 24 bp; single-stranded, linear
  oligonucleotide primer
gggagcatgtgaatgccatccagg

SEQ ID NO: 60 - DNA, 24 bp; single-stranded, linear
  oligonucleotide primer
gtatcagggtcagtgtgcccaggg

SEQ ID NO: 61 - DNA, 24 bp; single-stranded, linear
  oligonucleotide primer
gaagagcccagaggaggagtttgg

SEQ ID NO: 62 - DNA, 24 bp; single-stranded, linear
  oligonucleotide primer
gtggactcagacaccaactgctgc

SEQ ID NO: 63 - DNA, 27 bp; single-stranded, linear
  oligonucleotide primer
agctacaaatccatctgttctctgggc

SEQ ID NO: 64 - DNA, 27 bp; single-stranded, linear
  oligonucleotide primer
ccaacctcctgtatcacacatgcttcc

SEQ ID NO: 65 - DNA, 26 bp; single-stranded, linear
  oligonucleotide primer
gagatggcagggactctgataacacc

SEQ ID NO: 66 - DNA, 26 bp; single-stranded, linear
  oligonucleotide primer
aaagtgctaggattacaggcgtgagc

SEQ ID NO: 67 - DNA, 24 bp; single-stranded, linear
  oligonucleotide primer
tgcaatgggcactgggatgagccg

SEQ ID NO: 68 - DNA, 23 bp; single-stranded, linear
  oligonucleotide primer
cggtgatgttcgggagtcaaacc

SEQ ID NO: 69 - DNA, 24 bp; single-stranded, linear
  oligonucleotide primer
cctacgatggaaccacacccctgc

SEQ ID NO: 70 - DNA, 24 bp; single-stranded, linear
  oligonucleotide primer
tccaccagctctctgactgtaccc

SEQ ID NO: 71 - DNA, 28 bp; single-stranded, linear
  oligonucleotide primer
ccagtcaagctcgtaaatacgtgaatgc

SEQ ID NO: 72 - DNA, 28 bp; single-stranded, linear
  oligonucleotide primer
acttggtcgtgctctcaactgttgtacc

SEQ ID NO: 73 - DNA, 23 bp; single-stranded, linear
  oligonucleotide primer
gcccctcctcagcatcttatccg

SEQ ID NO: 74 - DNA, 23 bp; single-stranded, linear
  oligonucleotide primer
tcccaggacaggcacaaacacgc

SEQ ID NO: 75 - DNA, 27 bp; single-stranded, linear
  oligonucleotide primer
tctagggtggaaatggatacacgaacc

SEQ ID NO: 76 - DNA, 26 bp; single-stranded, linear
  oligonucleotide primer
tgttacaagcatcatcgttgtcgtcg

SEQ ID NO: 77 - DNA, 26 bp; single-stranded, linear
  oligonucleotide primer
cagctaccgcgatgagaggcgctcgc

SEQ ID NO: 78 - DNA, 28 bp; single-stranded, linear
  oligonucleotide primer
acagcggaccagcgtgtcgttgtcttct

SEQ ID NO: 79 - DNA, 26 bp; single-stranded, linear
  oligonucleotide primer
ctctcctatcagctaacccattatgg

SEQ ID NO: 80 - DNA, 27 bp; single-stranded, linear
  oligonucleotide primer
actgaccaaaccagtgtgactgtctgc

SEQ ID NO: 81 - DNA, 27 bp; single-stranded, linear
  oligonucleotide primer
tcctcgggagatatttcaaacatttgg

SEQ ID NO: 82 - DNA, 28 bp; single-stranded, linear
  oligonucleotide primer
ctggctttaatcctaaaccatgtaaggg

SEQ ID NO: 83 - DNA, 24 bp; single-stranded, linear
  oligonucleotide primer
gccgtggagcaggtgaagaatgcc

SEQ ID NO: 84 - DNA, 24 bp; single-stranded, linear
  oligonucleotide primer
agctatcccagagccccagatccg

SEQ ID NO: 85 - DNA, 22 bp; single-stranded, linear
  oligonucleotide primer
ccttgggagcaggtgcttgtgg

SEQ ID NO: 86 - DNA, 23 bp; single-stranded, linear
  oligonucleotide primer
aaggagaccgacttgcagagagg

SEQ ID NO: 87 - DNA, 23 bp; single-stranded, linear
  oligonucleotide primer
ggtcctcctttggctcacgctgc

SEQ ID NO: 88 - DNA, 21 bp; single-stranded, linear
  oligonucleotide primer
ggcttcccactgttctcaggg

SEQ ID NO: 89 - DNA, 23 bp; single-stranded, linear
  oligonucleotide primer
gagggtctcttaggtgcatgtcc

SEQ ID NO: 90 - DNA, 24 bp; single-stranded, linear
  oligonucleotide primer
actctcatgggatgtggcgagccc

SEQ ID NO: 91 - DNA, 24 bp; single-stranded, linear
  oligonucleotide primer
atcctcagcaaagggcgtgactgg

SEQ ID NO: 92 - DNA, 22 bp; single-stranded, linear
  oligonucleotide primer
cctgcctctctgcacatggagc

SEQ ID NO: 93 - DNA, 23 bp; single-stranded, linear
  oligonucleotide primer
ctacgtcgccctggacttcgagc

SEQ ID NO: 94 - DNA, 23 bp; single-stranded, linear
  oligonucleotide primer
gatggagccgccgatccacacgg

SEQ ID NO: 95 - DNA, 26 bp; single-stranded, linear
  oligonucleotide primer
cgcctgattacacagatgaatcttgc

SEQ ID NO: 96 - DNA, 26 bp; single-stranded, linear
  oligonucleotide primer
ttccctctgactgttcttcaatgacg

SEQ ID NO: 97 - DNA, 26 bp; single-stranded, linear
  oligonucleotide primer
gctctttcctggctactccatgttgg

SEQ ID NO: 98 - DNA, 26 bp; single-stranded, linear
  oligonucleotide primer
tgagtttcgataaggatctcggtggc

SEQ ID NO: 99 - DNA, 26 bp; single-stranded, linear
  oligonucleotide primer
gatctacatcacagtccgaaatccgc

SEQ ID NO: 100 - DNA, 26 bp; single-stranded, linear
  oligonucleotide primer
tgttgtggagaccctgcctcatgtcg

SEQ ID NO: 101 - DNA, 24 bp; single-stranded, linear
  oligonucleotide primer
actgagaccatcccttccacctcg

SEQ ID NO: 102 - DNA, 24 bp; single-stranded, linear
  oligonucleotide primer
ggtaaccctccttgcagcctttgg

SEQ ID NO: 103 - DNA, 26 bp; single-stranded, linear
  oligonucleotide primer
gtttcgtgttcggagccgctttaacc

SEQ ID NO: 104 - DNA, 26 bp; single-stranded, linear
  oligonucleotide primer
ggcagagtcgttcactgtagtctggc

SEQ ID NO: 105 - DNA, 25 bp; single-stranded, linear
  oligonucleotide primer
gcatggtgagcagagtgccctatcc

SEQ ID NO: 106 - DNA, 26 bp; single-stranded, linear
  oligonucleotide primer
acaggtacttctgtttcccttcagcg

SEQ ID NO: 107 - DNA, 24 bp; single-stranded, linear
  oligonucleotide primer
gccgctccaacacttaccccaagg

SEQ ID NO: 108 - DNA, 23 bp; single-stranded, linear
  oligonucleotide primer
ggtgatagctgtggcattgtggc

SEQ ID NO: 109 - DNA, 23 bp; single-stranded, linear
  oligonucleotide primer
cgcccctctctggctcatgtacc

SEQ ID NO: 110 - DNA, 23 bp; single-stranded, linear
  oligonucleotide primer
ctgacctgctctccgtcactgcc

SEQ ID NO: 111 - DNA, 28 bp; single-stranded, linear
  oligonucleotide primer
ctcacgcagaaggaagatgattgtgacg

SEQ ID NO: 112 - DNA, 28 bp; single-stranded, linear
  oligonucleotide primer
gaaagagtagtaaagcagcaacaactgg

SEQ ID NO: 113 - DNA, 23 bp; single-stranded, linear
  oligonucleotide primer
acactgtgccctgagctgccccc

SEQ ID NO: 114 - DNA, 23 bp; single-stranded, linear
  oligonucleotide primer
atgcccctgctcctgagagaggc

SEQ ID NO: 115 - DNA, 26 bp; single-stranded, linear
  oligonucleotide primer
aatctgagtgcggtggagcgggcctg

SEQ ID NO: 116 - DNA, 25 bp; single-stranded, linear
  oligonucleotide primer
gggttcatggccgagttgccgtgcg

SEQ ID NO: 117 - DNA, 24 bp; single-stranded, linear
  oligonucleotide primer
tccgttccctgcccattgaagacc

SEQ ID NO: 118 - DNA, 23 bp; single-stranded, linear
  oligonucleotide primer
gagtcagtgccatctcctcttgc

SEQ ID NO: 119 - DNA, 24 bp; single-stranded, linear
  oligonucleotide primer
tcttgtttgctctgtcatggctgc

SEQ ID NO: 120 - DNA, 24 bp; single-stranded, linear
  oligonucleotide primer
gtggagtgggggagatataattgg

SEQ ID NO: 121 - DNA, 32 bp; single-stranded, linear
  oligonucleotide primer
ttatcatcatccacctggttgaagtagtaccc

SEQ ID NO: 122 - DNA, 30 bp; single-stranded, linear
  oligonucleotide primer
gtcacaagcacccggacaatgttgagcaaa

SEQ ID NO: 123 - DNA, 25 bp; single-stranded, linear
  oligonucleotide primer
aggactccaggcagcagacacatgc

SEQ ID NO: 124 - DNA, 26 bp; single-stranded, linear
  oligonucleotide primer
tgatctactttgctcttgagggcagg

SEQ ID NO: 125 - DNA, 26 bp; single-stranded, linear
  oligonucleotide primer
taaacatgaccctgggcttctgtacc

SEQ ID NO: 126 - DNA, 26 bp; single-stranded, linear
  oligonucleotide primer
tctcctcactggttctactatctggc

SEQ ID NO: 127 - DNA, 23 bp; single-stranded, linear
  oligonucleotide primer
gcacagggatcacattgtcgggg

SEQ ID NO: 128 - DNA, 21 bp; single-stranded, linear
  oligonucleotide primer
gaggggctggaagaacatcgc

SEQ ID NO: 129 - DNA, 23 bp; single-stranded, linear
  oligonucleotide primer
ggcttccagctcagaacccatcc

SEQ ID NO: 130 - DNA, 23 bp; single-stranded, linear
  oligonucleotide primer
aacaccaacaaggcagggacccc

SEQ ID NO: 131 - DNA, 23 bp; single-stranded, linear
  oligonucleotide primer
gacttcgactgtgacctgtgggg

SEQ ID NO: 132 - DNA, 23 bp; single-stranded, linear
  oligonucleotide primer
gggttccatctcagctcaagggg

SEQ ID NO: 133 - DNA, 30 bp; single-stranded, linear
  oligonucleotide primer
tcgacaggctcacattctacttgactgtgg

SEQ ID NO: 134 - DNA, 31 bp; single-stranded, linear
  oligonucleotide primer
agttgagttccagccttcattgggtttccaa

SEQ ID NO: 135 - DNA, 28 bp; single-stranded, linear
  oligonucleotide primer
gcgcagcaaggctcgttcctgttcagaa

SEQ ID NO: 136 - DNA, 30 bp; single-stranded, linear
  oligonucleotide primer
cgccataaggtggtggttgtcgtctgacaa

SEQ ID NO: 137 - DNA, 30 bp; single-stranded, linear
  oligonucleotide primer
acattgaagccacaggactgagcacggaag

SEQ ID NO: 138 - DNA, 31 bp; single-stranded, linear
  oligonucleotide primer
cgtccatagtgctgaaatcaggtctcatcaa

SEQ ID NO: 139 - DNA, 31 bp; single-stranded, linear
  oligonucleotide primer
aattgcagcgatgcctggcaaattgaagttg

SEQ ID NO: 140 - DNA, 31 bp; single-stranded, linear
  oligonucleotide primer
caaagcgtccattcagttagtcagtgtgaga

SEQ ID NO: 141 - DNA, 29 bp; single-stranded, linear
  oligonucleotide primer
catctgcttaatctgtggagaccgccagg

SEQ ID NO: 142 - DNA, 29 bp; single-stranded, linear
  oligonucleotide primer
ctaggactgtgctctgctgtgttcccact

SEQ ID NO: 143 - DNA, 29 bp; single-stranded, linear
  oligonucleotide primer
ccggaagtctctggctcttgacattgtgg

SEQ ID NO: 144 - DNA, 30 bp; single-stranded, linear
  oligonucleotide primer
ccctgtaaacatgagaatgggctcgtgaca

SEQ ID NO: 145 - DNA, 31 bp; single-stranded, linear
  oligonucleotide primer
ctacagtgtctataccaccaagagtgatgtc

SEQ ID NO: 146 - DNA, 30 bp; single-stranded, linear
  oligonucleotide primer
ggctgtaagggtcagactggtcacaggtta

SEQ ID NO: 147 - DNA, 28 bp; single-stranded, linear
  oligonucleotide primer
caggtgcttcccagacactggcgttact

SEQ ID NO: 148 - DNA, 31 bp; single-stranded, linear
  oligonucleotide primer
actcatattaccaaggaataactggcgggca

SEQ ID NO: 149 - DNA, 28 bp; single-stranded, linear
  oligonucleotide primer
tgaagtcaagtgggcagggcgaagttgg

SEQ ID NO: 150 - DNA, 28 bp; single-stranded, linear
  oligonucleotide primer
agccaggtggaaatcctacagcgcgtca

SEQ ID NO: 151 - DNA, 30 bp; single-stranded, linear
  oligonucleotide primer
ctaccaaagcaccttagctggcattacagc

SEQ ID NO: 152 - DNA, 31 bp; single-stranded, linear
  oligonucleotide primer
ctgtcacatgacaagtgggagtttgtagaga

SEQ ID NO: 153 - DNA, 31 bp; single-stranded, linear
  oligonucleotide primer
caaatcagacagcagcaatggacactcttaa

SEQ ID NO: 154 - DNA, 30 bp; single-stranded, linear
  oligonucleotide primer
gtaatcgcagtagtggatgcgtcgtttctc

SEQ ID NO: 155 - DNA, 31 bp; single-stranded, linear
  oligonucleotide primer
tgtagctgttggagaacttctacgacatttc

SEQ ID NO: 156 - DNA, 31 bp; single-stranded, linear
  oligonucleotide primer
gttggcgtggagcagatgtttcttatcactc

SEQ ID NO: 157 - DNA, 28 bp; single-stranded, linear
  oligonucleotide primer
gaaagccttcagtcccgtgaggtccgtt

SEQ ID NO: 158 - DNA, 30 bp; single-stranded, linear
  oligonucleotide primer
ctggtgatgcaggctgacaatagtgggatg

SEQ ID NO: 159 - DNA, 31 bp; single-stranded, linear
  oligonucleotide primer
aagatatgctaagcagtagtcgtcaagttgc

SEQ ID NO: 160 - DNA, 30 bp; single-stranded, linear
  oligonucleotide primer
cttgggaccagtgcagcacctttacaagta

SEQ ID NO: 161 - DNA, 31 bp; single-stranded, linear
  oligonucleotide primer
atatctctaccttccgcacaacaggtgactg

SEQ ID NO: 162 - DNA, 31 bp; single-stranded, linear
  oligonucleotide primer
caccagtatctccagaattattgtctgtctg

SEQ ID NO: 163 - DNA, 28 bp; single-stranded, linear
  oligonucleotide primer
gcgaagtccgcctcgtcagtttgcacat

SEQ ID NO: 164 - DNA, 30 bp; single-stranded, linear
  oligonucleotide primer
catggttgttgacagtacgggagtcacaga

SEQ ID NO: 165 - DNA, 28 bp; single-stranded, linear
  oligonucleotide primer
ctaagtaccagggctggaggtctcggaa

SEQ ID NO: 166 - DNA, 31 bp; single-stranded, linear
  oligonucleotide primer
gcttgttagaccgttggtcaatgagtcttcc

SEQ ID NO: 167 - DNA, 31 bp; single-stranded, linear
  oligonucleotide primer
accatcattgctctggaccgctgtatttgtg

SEQ ID NO: 168 - DNA, 30 bp; single-stranded, linear
  oligonucleotide primer
actgtgatgatggacataggcaccgtgaag

SEQ ID NO: 169 - DNA, 31 bp; single-stranded, linear
  oligonucleotide primer
ttccaaatcatcctggtggaatgggtatcac

SEQ ID NO: 170 - DNA, 31 bp; single-stranded, linear
  oligonucleotide primer
gttgcgatgtctgctaaatgagaaccttact

SEQ ID NO: 171 - DNA, 30 bp; single-stranded, linear
  oligonucleotide primer
gtggtcaaccttctaggtgcctgtaccaag

SEQ ID NO: 172 - DNA, 30 bp; single-stranded, linear
  oligonucleotide primer
ccaagaactccatgcccttagccacttgga

SEQ ID NO: 173 - DNA, 31 bp; single-stranded, linear
  oligonucleotide primer
ccggatgtttccagatatttgtgcctcacac

SEQ ID NO: 174 - DNA, 31 bp; single-stranded, linear
  oligonucleotide primer
cctccgagaatgcccttattaaattaagtgc

SEQ ID NO: 175 - DNA, 29 bp; single-stranded, linear
  oligonucleotide primer
gtcataacgaggccctaaatggtctgcgc

SEQ ID NO: 176 - DNA, 30 bp; single-stranded, linear
  oligonucleotide primer
ttcacgttgaacaacgaagcaaagcgcacc

SEQ ID NO: 177 - DNA, 30 bp; single-stranded, linear
  oligonucleotide primer
caggctttactggactcagaaggcaatgct

SEQ ID NO: 178 - DNA, 31 bp; single-stranded, linear
  oligonucleotide primer
tatctcatgctgtccattagctttgtgggaa

SEQ ID NO: 179 - DNA, 30 bp; single-stranded, linear
  oligonucleotide primer
atgagcaaccaggatgtcatcaatgccgtg

SEQ ID NO: 180 - DNA, 30 bp; single-stranded, linear
  oligonucleotide primer
ccaactgtcgtgaaggttgtgtaatctggg

SEQ ID NO: 181 - DNA, 31 bp; single-stranded, linear
  oligonucleotide primer
ctagatattatcctactgaagatgtgcctcg

SEQ ID NO: 182 - DNA, 31 bp; single-stranded, linear
  oligonucleotide primer
atcttgcgctgctccgtaatctcatatttct

SEQ ID NO: 183 - DNA, 31 bp; single-stranded, linear
  oligonucleotide primer
agcagaaagttcaacttccaaagggttagga

SEQ ID NO: 184 - DNA, 31 bp; single-stranded, linear
  oligonucleotide primer
gctgcaaacaccctgggccagatttcttaaa

SEQ ID NO: 185 - DNA, 30 bp; single-stranded, linear
  oligonucleotide primer
tctcccaaatgctccacattgccagtcaga

SEQ ID NO: 186 - DNA, 30 bp; single-stranded, linear
  oligonucleotide primer
tgacctccgtgtttgagagttggaaccatg

SEQ ID NO: 187 - DNA, 30 bp; single-stranded, linear
  oligonucleotide primer
ggagagtatcttgctgggcaagttcactac

SEQ ID NO: 188 - DNA, 29 bp; single-stranded, linear
  oligonucleotide primer
catgggtgagtggtaggtcttgtagggag

SEQ ID NO: 189 - DNA, 31 bp; single-stranded, linear
  oligonucleotide primer
tagatgtggtgatgaacctccagttccacta

SEQ ID NO: 190 - DNA, 30 bp; single-stranded, linear
  oligonucleotide primer
ggatgacctgttgtgggaagtcactcatgg

SEQ ID NO: 191 - DNA, 26 bp; single-stranded, linear
  oligonucleotide primer
caggaatttgcttccaggtgtgcctg

SEQ ID NO: 192 - DNA, 29 bp; single-stranded, linear
  oligonucleotide primer
cagtgtttcactgggaaatgtgacttgca

SEQ ID NO: 193 - DNA, 28 bp; single-stranded, linear
  oligonucleotide primer
gcgccttgactgaggacagcatagacga

SEQ ID NO: 194 - DNA, 30 bp; single-stranded, linear
  oligonucleotide primer
ggagcccttaaagatgccatttggcttggc

SEQ ID NO: 195 - DNA, 31 bp; single-stranded, linear
  oligonucleotide primer
cccagcctcaggatgttgtatctaagtacaa

SEQ ID NO: 196 - DNA, 30 bp; single-stranded, linear
  oligonucleotide primer
gaaagtatccaaggccataaggcactgctg

SEQ ID NO: 197 - DNA, 30 bp; single-stranded, linear
  oligonucleotide primer
ccattcaaccagatccctggcaattccctc

SEQ ID NO: 198 - DNA, 31 bp; single-stranded, linear
  oligonucleotide primer
taagggactcaggataaagtcatcagtcaca

SEQ ID NO: 199 - DNA, 29 bp; single-stranded, linear
  oligonucleotide primer
agcgtaagctgattgagcagaaccgggag

SEQ ID NO: 200 - DNA, 29 bp; single-stranded, linear
  oligonucleotide primer
gaggatgatctggtcttcgcaaggcagct

SEQ ID NO: 201 - DNA, 31 bp; single-stranded, linear
  oligonucleotide primer
gagcaatcaggaggttatgaagagcattgag

SEQ ID NO: 202 - DNA, 31 bp; single-stranded, linear
  oligonucleotide primer
gggatcagtccttgaatccctgaatactgca

SEQ ID NO: 203 - DNA, 30 bp; single-stranded, linear
  oligonucleotide primer
gactcctgcgaccgcatcaaagacgaattt

SEQ ID NO: 204 - DNA, 29 bp; single-stranded, linear
  oligonucleotide primer
gctgtcggatgatagagttcagctcggga

SEQ ID NO: 205 - DNA, 28 bp; single-stranded, linear
  oligonucleotide primer
cctcttgtcatcccactcagcgccatgt

SEQ ID NO: 206 - DNA, 30 bp; single-stranded, linear
  oligonucleotide primer
ctcccgtgtaatagcgtagtccaaccacat

SEQ ID NO: 207 - DNA, 28 bp; single-stranded, linear
  oligonucleotide primer
acgttccacagggccaggtgagctttct

SEQ ID NO: 208 - DNA, 28 bp; single-stranded, linear
  oligonucleotide primer
aactacatccggcagcagtccgagacct

SEQ ID NO: 209 - DNA, 30 bp; single-stranded, linear
  oligonucleotide primer
tgcagccatgagcagcaatgagtgcttcaa

SEQ ID NO: 210 - DNA, 29 bp; single-stranded, linear
  oligonucleotide primer
ctctaccgcagttatagcaggcatcctcc

SEQ ID NO: 211 - DNA, 28 bp; single-stranded, linear
  oligonucleotide primer
ggacaagtcgagcggcaagcattacggt

SEQ ID NO: 212 - DNA, 28 bp; single-stranded, linear
  oligonucleotide primer
ccggaagcacttcttgagacggcagtac

SEQ ID NO: 213 - DNA, 28 bp; single-stranded, linear
  oligonucleotide primer
catcgtgctgttcacgtcagacgcctgt

SEQ ID NO: 214 - DNA, 31 bp; single-stranded, linear
  oligonucleotide primer
gtaacatatcgcggatgagagtttcgatggg

SEQ ID NO: 215 - DNA, 30 bp; single-stranded, linear
  oligonucleotide primer
ctgcacaagttccacgagaatgacaacggg

SEQ ID NO: 216 - DNA, 29 bp; single-stranded, linear
  oligonucleotide primer
gaatcggtggtcacccaattagcctcgca

SEQ ID NO: 217 - DNA, 28 bp; single-stranded, linear
  oligonucleotide primer
agtgcggagccctctgtgtttgtgagga

SEQ ID NO: 218 - DNA, 30 bp; single-stranded, linear
  oligonucleotide primer
gcttgtctaagacgccttgctcactgagtt

SEQ ID NO: 219 - DNA, 30 bp; single-stranded, linear
  oligonucleotide primer
tgcagaagttcgcgtttgcactgtacttgc

SEQ ID NO: 220 - DNA, 30 bp; single-stranded, linear
  oligonucleotide primer
tcagtattgccatccaaatgcgccatgctg

SEQ ID NO: 221 - DNA, 30 bp; single-stranded, linear
  oligonucleotide primer
gattcagaagtgcctaactgccagtcatcc

SEQ ID NO: 222 - DNA, 30 bp; single-stranded, linear
  oligonucleotide primer
ggttctatcagcttgaactccatgcctcga

SEQ ID NO: 223 - DNA, 30 bp; single-stranded, linear
  oligonucleotide primer
agaccgaggtgtatcaccaaggtctcaaga

SEQ ID NO: 224 - DNA, 30 bp; single-stranded, linear
  oligonucleotide primer
tgtgatctgacaccctgagtagttcacacc

SEQ ID NO: 225 - DNA, 28 bp; single-stranded, linear
  oligonucleotide primer
catccagaccatcgcgctcatcacgtac

SEQ ID NO: 226 - DNA, 30 bp; single-stranded, linear
  oligonucleotide primer
caacggatcttggcgaggatgtgcttgtct

SEQ ID NO: 227 - DNA, 30 bp; single-stranded, linear
  oligonucleotide primer
aaattccagtaaggtggacagcacccgaag

SEQ ID NO: 228 - DNA, 31 bp; single-stranded, linear
  oligonucleotide primer
tgaccaaccagtgtgatccctaaactcatca

SEQ ID NO: 229 - DNA, 29 bp; single-stranded, linear
  oligonucleotide primer
cctattcccgaagccgttacctcgaatgc

SEQ ID NO: 230 - DNA, 30 bp; single-stranded, linear
  oligonucleotide primer
gagtgccggtggctaccagacattgattca

SEQ ID NO: 231 - DNA, 28 bp; single-stranded, linear
  oligonucleotide primer
accaggagtcctaccctctgtcagtgtc

SEQ ID NO: 232 - DNA, 31 bp; single-stranded, linear
  oligonucleotide primer
gatagacgtaatcccaaagcagtctacagtc

SEQ ID NO: 233 - DNA, 30 bp; single-stranded, linear
  oligonucleotide primer
agtgtggcaggtgatccggttcctaatatg

SEQ ID NO: 234 - DNA, 30 bp; single-stranded, linear
  oligonucleotide primer
gccgtggtactccgtgtgattggtaacatg

SEQ ID NO: 235 - DNA, 31 bp; single-stranded, linear
  oligonucleotide primer
gctatcaacaccctgaatggattgagacttc

SEQ ID NO: 236 - DNA, 31 bp; single-stranded, linear
  oligonucleotide primer
tcgcttgtcaaatcgaataaaccctacaccc

SEQ ID NO: 237 - DNA, 31 bp; single-stranded, linear
  oligonucleotide primer
gtgacaagcggtgtaacaagaaacggttgtg

SEQ ID NO: 238 - DNA, 31 bp; single-stranded, linear
  oligonucleotide primer
accagaatgatatactggatggtcacactca

SEQ ID NO: 239 - DNA, 31 bp; single-stranded, linear
  oligonucleotide primer
catagattgcagcatctccagtgacaagttt

SEQ ID NO: 240 - DNA, 29 bp; single-stranded, linear
  oligonucleotide primer
caggaactgcccagttgctaaggccactt

SEQ ID NO: 241 - DNA, 29 bp; single-stranded, linear
  oligonucleotide primer
atgaactacctgaacgacaacctcgcttc

SEQ ID NO: 242 - DNA, 30 bp; single-stranded, linear
  oligonucleotide primer
cgtaaccattcttcagttaggtcttcggta

SEQ ID NO: 243 - DNA, 27 bp; single-stranded, linear
  oligonucleotide primer
aatggctggctgtggatgggttggtca

SEQ ID NO: 244 - DNA, 29 bp; single-stranded, linear
  oligonucleotide primer
gatcatggcaacgtaagcagtgtagtctg

SEQ ID NO: 245 - DNA, 27 bp; single-stranded, linear
  oligonucleotide primer
tccagctctgtcatcactcaggcacct

SEQ ID NO: 246 - DNA, 30 bp; single-stranded, linear
  oligonucleotide primer
tggtgagtcaatgcagccttcaacctcatt

SEQ ID NO: 247 - DNA, 30 bp; single-stranded, linear
  oligonucleotide primer
cttcaagcattggataatcccgaatatcac

SEQ ID NO: 248 - DNA, 30 bp; single-stranded, linear
  oligonucleotide primer
agcttacaccacagtattccggtgtctgta

SEQ ID NO: 249 - DNA, 28 bp; single-stranded, linear
  oligonucleotide primer
cttcagttgtgccatctgagcgtgctcg

SEQ ID NO: 250 - DNA, 29 bp; single-stranded, linear
  oligonucleotide primer
cacagtctgtctttgctgataagggtgac

SEQ ID NO: 251 - DNA, 29 bp; single-stranded, linear
  oligonucleotide primer
ctctccaagtctcagtggcttcatctgtc

SEQ ID NO: 252 - DNA, 30 bp; single-stranded, linear
  oligonucleotide primer
agcagtaagagtccgtgctttcacattcct

SEQ ID NO: 253 - DNA, 28 bp; single-stranded, linear
  oligonucleotide primer
cgcaggccatttatgccagtgttcttcc

SEQ ID NO: 254 - DNA, 30 bp; single-stranded, linear
  oligonucleotide primer
tacaagtgcatcccttagaagcgacagata

SEQ ID NO: 255 - DNA, 26 bp; single-stranded, linear
  oligonucleotide primer
gtgttcgaccagggccagtttgccaa

SEQ ID NO: 256 - DNA, 28 bp; single-stranded, linear
  oligonucleotide primer
cgctgtcctggcggatctttatgtcttc

SEQ ID NO: 257 - DNA, 30 bp; single-stranded, linear
  oligonucleotide primer
ttaacagtgggtgccaactcatgctaacgc

SEQ ID NO: 258 - DNA, 31 bp; single-stranded, linear
  oligonucleotide primer
gagatcgaatgttaggtccatgcagttcttg

SEQ ID NO: 259 - DNA, 30 bp; single-stranded, linear
  oligonucleotide primer
atatgccaccgattgcaggacacaagcaca

SEQ ID NO: 260 - DNA, 31 bp; single-stranded, linear
  oligonucleotide primer
gtcactaacctaagtttccaaattggcttgc

SEQ ID NO: 261 - DNA, 28 bp; single-stranded, linear
  oligonucleotide primer
tctaaggaccgtcctgcgagatcgcctt

SEQ ID NO: 262 - DNA, 28 bp; single-stranded, linear
  oligonucleotide primer
aaacgggcatgaggcatagcgtccctca

SEQ ID NO: 263 - DNA, 28 bp; single-stranded, linear
  oligonucleotide primer
cagcctcggcctgatttcccgtaaaggt

SEQ ID NO: 264 - DNA, 28 bp; single-stranded, linear
  oligonucleotide primer
ctggcaaccagcacagggacttaggtga

SEQ ID NO: 265 - DNA, 28 bp; single-stranded, linear
  oligonucleotide primer
tcccagaggtgaaagttcactcgggcag

SEQ ID NO: 266 - DNA, 31 bp; single-stranded, linear
  oligonucleotide primer
gagccatgccttattccaatgactgtaaaca

SEQ ID NO: 267 - DNA, 27 bp; single-stranded, linear
  oligonucleotide primer
tatggctgcctcttagaccatgtccgg

SEQ ID NO: 268 - DNA, 27 bp; single-stranded, linear
  oligonucleotide primer
ttgggactcttgaccagcacgttccga

SEQ ID NO: 269 - DNA, 30 bp; single-stranded, linear
  oligonucleotide primer
gccgatgtccattgttgccatctgctatgg

SEQ ID NO: 270 - DNA, 31 bp; single-stranded, linear
  oligonucleotide primer
gtagatgaagctggaactggcattagggtag

SEQ ID NO: 271 - DNA, 32 bp; single-stranded, linear
  oligonucleotide primer
agcttctaggcatctgaaacttgcttcatctc

SEQ ID NO: 272 - DNA, 32 bp; single-stranded, linear
  oligonucleotide primer
attagtcgctggttgaaagcagcaatgccatt

SEQ ID NO: 273 - DNA, 28 bp; single-stranded, linear
  oligonucleotide primer
ccttctgggcagttgatgccgtggcaaa

SEQ ID NO: 274 - DNA, 28 bp; single-stranded, linear
  oligonucleotide primer
aggatgactgtggtcttgagggccttgc

SEQ ID NO: 275 - DNA, 32 bp; single-stranded, linear
  oligonucleotide primer
gaagggcttggactcaagcaagatttcagatt

SEQ ID NO: 276 - DNA, 32 bp; single-stranded, linear
  oligonucleotide primer
gtgcttagcccactccctgaattgtttgattt

SEQ ID NO: 277 - DNA, 26 bp; single-stranded, linear
  oligonucleotide primer
accacgacctcgtcctgatccggctg

SEQ ID NO: 278 - DNA, 27 bp; single-stranded, linear
  oligonucleotide primer
ccgtagaggtaagccacgccgttcttc

SEQ ID NO: 279 - DNA, 28 bp; single-stranded, linear
  oligonucleotide primer
tggtgttcgccaagatgaagggctaccc

SEQ ID NO: 280 - DNA, 28 bp; single-stranded, linear
  oligonucleotide primer
ggaggactgatagccggaagccttgaca

SEQ ID NO: 281 - DNA, 26 bp; single-stranded, linear
  oligonucleotide primer
gccggagggccaagcgtagccctaag

SEQ ID NO: 282 - DNA, 27 bp; single-stranded, linear
  oligonucleotide primer
ctgcctgatctcagcggcacccacatc

SEQ ID NO: 283 - DNA, 29 bp; single-stranded, linear
  oligonucleotide primer
acgctgctgctggtatgttgtatctcgag

SEQ ID NO: 284 - DNA, 30 bp; single-stranded, linear
  oligonucleotide primer
tgctgatttgtcattccagggtacggacaa

SEQ ID NO: 285 - DNA, 32 bp; single-stranded, linear
  oligonucleotide primer
ttcctcgcaactttgtggtagattactatgag

SEQ ID NO: 286 - DNA, 32 bp; single-stranded, linear
  oligonucleotide primer
cccataggacacttatcctttggctaaactaa

SEQ ID NO: 287 - DNA, 30 bp; single-stranded, linear
  oligonucleotide primer
ggccttgtttgcaggaagccgactgtaaag

SEQ ID NO: 288 - DNA, 31 bp; single-stranded, linear
  oligonucleotide primer
gggataacatctccacactcacagtaagctc

SEQ ID NO: 289 - DNA, 28 bp; single-stranded, linear
  oligonucleotide primer
tgcgggcaagagtccagaggaccttgag

SEQ ID NO: 290 - DNA, 30 bp; single-stranded, linear
  oligonucleotide primer
ttgatgagcccattggtagaagcgtcgtga

SEQ ID NO: 291 - DNA, 28 bp; single-stranded, linear
  oligonucleotide primer
ttagcttaggaggcacaccctactgcgg

SEQ ID NO: 292 - DNA, 28 bp; single-stranded, linear
  oligonucleotide primer
gcagttgtcaagggtctcccatgccagt

SEQ ID NO: 293 - DNA, 32 bp; single-stranded, linear
  oligonucleotide primer
cagcttgagaattgccctcagtgaacatctta

SEQ ID NO: 294 - DNA, 32 bp; single-stranded, linear
  oligonucleotide primer
gccaagttaataccgatgtaatccatgagcag

SEQ ID NO: 295 - DNA, 28 bp; single-stranded, linear
  oligonucleotide primer
cccgtgccaaggacccatcgagatcaag

SEQ ID NO: 296 - DNA, 30 bp; single-stranded, linear
  oligonucleotide primer
cacatagactcagcacagtgattcccacgg

SEQ ID NO: 297 - DNA, 29 bp; single-stranded, linear
  oligonucleotide primer
aagacccagaggatgctgagcggattctg

SEQ ID NO: 298 - DNA, 29 bp; single-stranded, linear
  oligonucleotide primer
gtaatgctacagtgtgctctagggcaggg

SEQ ID NO: 299 - DNA, 32 bp; single-stranded, linear
  oligonucleotide primer
gggagtcttcataatacagcacagcggttaag

SEQ ID NO: 300 - DNA, 32 bp; single-stranded, linear
  oligonucleotide primer
cataggaacccagagtcaaccataactgaatg

SEQ ID NO: 301 - DNA, 26 bp; single-stranded, linear
  oligonucleotide primer
cgggcttggtgatctgcctcgtggtg

SEQ ID NO: 302 - DNA, 28 bp; single-stranded, linear
  oligonucleotide primer
gtcaggcgctgggagacaatggtacaac

SEQ ID NO: 303 - DNA, 26 bp; single-stranded, linear
  oligonucleotide primer
cggctcaggacctcacagactacggg

SEQ ID NO: 304 - DNA, 28 bp; single-stranded, linear
  oligonucleotide primer
ccactgcgcccagcccaacaacaattct

SEQ ID NO: 305 - DNA, 32 bp; single-stranded, linear
  oligonucleotide primer
cttcggtgtgaaaccagttctgaatactcctc

SEQ ID NO: 306 - DNA, 32 bp; single-stranded, linear
  oligonucleotide primer
aactcatttgggcacttgcacaagtatctcga

SEQ ID NO: 307 - DNA, 32 bp; single-stranded, linear
  oligonucleotide primer
ctctgccaatatcaccatcgtggaatcaaacg

SEQ ID NO: 308 - DNA, 32 bp; single-stranded, linear; identical to SEQ ID NO: 306
  oligonucleotide primer

SEQ ID NO: 309 - DNA, 30 bp; single-stranded, linear
  oligonucleotide primer
cctgcttgaatgtggtgaatacctcgctgc

SEQ ID NO: 310 - DNA, 30 bp; single-stranded, linear
  oligonucleotide primer
agatggaacagcacaatgagcgcaactcca

SEQ ID NO: 311 - DNA, 28 bp; single-stranded, linear
  oligonucleotide primer
aggagaccaaggcacaggacattctggg

SEQ ID NO: 312 - DNA, 30 bp; single-stranded, linear
  oligonucleotide primer
ctccaacaatccagaagtcctgtttgggag

SEQ ID NO: 313 - DNA, 27 bp; single-stranded, linear
  oligonucleotide primer
atcaagggtgaggcagagacccgcgtg

SEQ ID NO: 314 - DNA, 26 bp; single-stranded, linear
  oligonucleotide primer
actccggtgccatccaccgtacaggg

SEQ ID NO: 315 - DNA, 26 bp; single-stranded, linear
  oligonucleotide primer
ccggcatgttcaccgtgcggatggcg

SEQ ID NO: 316 - DNA, 31 bp; single-stranded, linear
  oligonucleotide primer
gacccaagttcaggacacgggattgatctat

SEQ ID NO: 317 - DNA, 28 bp; single-stranded, linear
  oligonucleotide primer
tacaccagtggcaagtgctccaacccag

SEQ ID NO: 318 - DNA, 30 bp; single-stranded, linear
  oligonucleotide primer
gtctcgaactcctgacctcaagtgatccac

SEQ ID NO: 319 - DNA, 28 bp; single-stranded, linear
  oligonucleotide primer
tctcccgtcttctgcctcccactccata

SEQ ID NO: 320 - DNA, 32 bp; single-stranded, linear
  oligonucleotide primer
gtctaattggctctacagaacctagtcaggtt

SEQ ID NO: 321 - DNA, 25 bp; single-stranded, linear
  oligonucleotide primer
acgcagtgcagactgtggtccgcca

SEQ ID NO: 322 - DNA, 27 bp; single-stranded, linear
  oligonucleotide primer
cgtagccgctctcaaccacggtgatgt

SEQ ID NO: 323 - DNA, 23 bp; single-stranded, linear
  oligonucleotide primer
cacactcggccagaccgggaccg

SEQ ID NO: 324 - DNA, 25 bp; single-stranded, linear
  oligonucleotide primer
gggtgtgacagagatgcgccacacg

SEQ ID NO: 325 - DNA, 27 bp; single-stranded, linear
  oligonucleotide primer
ctgtatcgcaggcactcaggtcagccg

SEQ ID NO: 326 - DNA, 28 bp; single-stranded, linear
  oligonucleotide primer
catggttggcgtgtccctgtgcagtcca

SEQ ID NO: 327 - DNA, 32 bp; single-stranded, linear
  oligonucleotide primer
gcagatattggctggagtgaatggattatctc

SEQ ID NO: 328 - DNA, 32 bp; single-stranded, linear
  oligonucleotide primer
agcgcaagactctactgtcatgttagggtata

SEQ ID NO: 329 - DNA, 25 bp; single-stranded, linear
  oligonucleotide primer
agcagccagtgctccaagcccggtg

SEQ ID NO: 330 - DNA, 28 bp; single-stranded, linear
  oligonucleotide primer
ttgtcagtctggtggctttggtgccatg

SEQ ID NO: 331 - DNA, 28 bp; single-stranded, linear
  oligonucleotide primer
ttctcaaactgaagctcgcactctcgcc

SEQ ID NO: 332 - DNA, 30 bp; single-stranded, linear
  oligonucleotide primer
tgtggagtgagtgttcaagtcttcggagtt

SEQ ID NO: 333 - DNA, 28 bp; single-stranded, linear
  oligonucleotide primer
tctttaccctcgtcctgccgggcacttt

SEQ ID NO: 334 - DNA, 27 bp; single-stranded, linear
  oligonucleotide primer
gaaagtggactcccacagggccacacg

SEQ ID NO: 335 - DNA, 25 bp; single-stranded, linear
  oligonucleotide primer
gggccacgcgggaccgactttccat

SEQ ID NO: 336 - DNA, 26 bp; single-stranded, linear
  oligonucleotide primer
tgggacaccctgccgctgttacagct

SEQ ID NO: 337 - DNA, 30 bp; single-stranded, linear
  oligonucleotide primer
cagtcagagttgaacaggtagttaagcccc

SEQ ID NO: 338 - DNA, 32 bp; single-stranded, linear
  oligonucleotide primer
agacataaaggcagctatggctgctaatgcaa

SEQ ID NO: 339 - DNA, 26 bp; single-stranded, linear
  oligonucleotide primer
cgtgcaggagtctgacgcctccgctc

SEQ ID NO: 340 - DNA, 26 bp; single-stranded, linear
  oligonucleotide primer
gtagacgcaccagcagagtcccgcct

SEQ ID NO: 341 - DNA, 30 bp; single-stranded, linear
  oligonucleotide primer
tggatggatggctaagggcagagttggata

SEQ ID NO: 342 - DNA, 32 bp; single-stranded, linear
  oligonucleotide primer
cgctgaccatacttgagtctaatgtgccagta

SEQ ID NO: 343 - DNA, 28 bp; single-stranded, linear
  oligonucleotide primer
cagcgcagctactgccatccaatcgaga

SEQ ID NO: 344 - DNA, 32 bp; single-stranded, linear
  oligonucleotide primer
gcttgtcacatctgcaagtacgttcgtttaac

SEQ ID NO: 345 - DNA, 26 bp; single-stranded, linear
  oligonucleotide primer
gcaagggtggcaagcatcaccttggc

SEQ ID NO: 346 - DNA, 25 bp; single-stranded, linear
  oligonucleotide primer
aggcaccggctggctgcggtctact

SEQ ID NO: 347 - DNA, 26 bp; single-stranded, linear
  oligonucleotide primer
tgcacctcagcgacaacctcttgggg

SEQ ID NO: 348 - DNA, 26 bp; single-stranded, linear
  oligonucleotide primer
caatgccgcacaggtcccggcagttg

SEQ ID NO: 349 - DNA, 26 bp; single-stranded, linear
  oligonucleotide primer
cccagggctggaatactgctacaacc

SEQ ID NO: 350 - DNA, 28 bp; single-stranded, linear
  oligonucleotide primer
ggtgtagatccggtcaaataatgcctcg

SEQ ID NO: 351 - DNA, 30 bp; single-stranded, linear
  oligonucleotide primer
ctgatggaccaggaagccctgaatccataa

SEQ ID NO: 352 - DNA, 32 bp; single-stranded, linear
  oligonucleotide primer
tgtcaataggaatgctaagcaaacaggcacga

SEQ ID NO: 353 - DNA, 26 bp; single-stranded, linear
  oligonucleotide primer
cactcggactggagctgagtgcaagc

SEQ ID NO: 354 - DNA, 29 bp; single-stranded, linear
  oligonucleotide primer
cttgaggtttgggcttggtcagtttgcca

SEQ ID NO: 355 - DNA, 29 bp; single-stranded, linear
  oligonucleotide primer
ataccagctccatctgctccaatgagggc

SEQ ID NO: 356 - DNA, 29 bp; single-stranded, linear
  oligonucleotide primer
tcggggacaggtgaagccatgtggtttcc

SEQ ID NO: 357 - DNA, 27 bp; single-stranded, linear
  oligonucleotide primer
gggacatgaactgtgtttgccgcctgg

SEQ ID NO: 358 - DNA, 26 bp; single-stranded, linear
  oligonucleotide primer
acgtgccgcaggtaggacagtaggtc

SEQ ID NO: 359 - DNA, 26 bp; single-stranded, linear
  oligonucleotide primer
aggcccagctctgaccagactccatg

SEQ ID NO: 360 - DNA, 28 bp; single-stranded, linear
  oligonucleotide primer
aaggactggttctgagcgttggtccaga

SEQ ID NO: 361 - DNA, 31 bp; single-stranded, linear
  oligonucleotide primer
aagagacagccaagtcttacaagggcagttg

SEQ ID NO: 362 - DNA, 32 bp; single-stranded, linear
  oligonucleotide primer
ctaaatgagacccaagtcccgcagtccttaaa

SEQ ID NO: 363 - DNA, 30 bp; single-stranded, linear
  oligonucleotide primer
ttcctcagcatagtgcaggacacgtcatgc

SEQ ID NO: 364 - DNA, 32 bp; single-stranded, linear
  oligonucleotide primer
cactgaaattatcactctggctcattcagctc

SEQ ID NO: 365 - DNA, 30 bp; single-stranded, linear
  oligonucleotide primer
aagaggttgggcttccatgcctgtagcttt

SEQ ID NO: 366 - DNA, 32 bp; single-stranded, linear
  oligonucleotide primer
ggtaatcagttaccaagaacagtcagctccaa

SEQ ID NO: 367 - DNA, 32 bp; single-stranded, linear
  oligonucleotide primer
ttgcgagttgtaaatgggattccaacacgaac

SEQ ID NO: 368 - DNA, 32 bp; single-stranded, linear
  oligonucleotide primer
gtgccactcgtaataggccatcatagttgatc

SEQ ID NO: 369 - DNA, 30 bp; single-stranded, linear
  oligonucleotide primer
catgaacacccggagcactacactataatg

SEQ ID NO: 370 - DNA, 30 bp; single-stranded, linear
  oligonucleotide primer
attccaactgccactgtcctgatttccatg

SEQ ID NO: 371 - DNA, 30 bp; single-stranded, linear
  oligonucleotide primer
gtgtgacagtattagtgagtgggtaacggc

SEQ ID NO: 372 - DNA, 32 bp; single-stranded, linear
  oligonucleotide primer
gtctatccttatgaatcgccagccaattctct

SEQ ID NO: 373 - DNA, 28 bp; single-stranded, linear
  oligonucleotide primer
gtaccacaatgtgggcatccttgtgctc

SEQ ID NO: 374 - DNA, 28 bp; single-stranded, linear
  oligonucleotide primer
gtcaacaccttggctgcaaacgccacga

SEQ ID NO: 375 - DNA, 27 bp; single-stranded, linear
  oligonucleotide primer
ccacgcggtccaccaagacactcaagg

SEQ ID NO: 376 - DNA, 26 bp; single-stranded, linear
  oligonucleotide primer
gtggcccatgaggctgtcgcctacac

SEQ ID NO: 377 - DNA, 28 bp; single-stranded, linear
  oligonucleotide primer
cacaccctcagcccacccacttacctta

SEQ ID NO: 378 - DNA, 28 bp; single-stranded, linear
  oligonucleotide primer
gcagttgtggctgccaggtctcactctc

SEQ ID NO: 379 - DNA, 25 bp; single-stranded, linear
  oligonucleotide primer
cgctccctgccaaggcgctgtcagt

SEQ ID NO: 380 - DNA, 26 bp; single-stranded, linear
  oligonucleotide primer
cccgcatggcctcctgttgtcgcttg

SEQ ID NO: 381 - DNA, 31 bp; single-stranded, linear
  oligonucleotide primer
gatggatgggaacgcaagagatacttacatg

SEQ ID NO: 382 - DNA, 32 bp; single-stranded, linear
  oligonucleotide primer
gtcttgttatgtttcccaggctggtcaatcat

SEQ ID NO: 383 - DNA, 32 bp; single-stranded, linear
  oligonucleotide primer
atgtaccaggtggagttcaagaccatgaatgc

SEQ ID NO: 384 - DNA, 32 bp; single-stranded, linear
  oligonucleotide primer
ggtatcatgtggatgtaatagtcccatccttc

SEQ ID NO: 385 - DNA, 32 bp; single-stranded, linear
  oligonucleotide primer
attctagcctggtttggagatactaactgctc

SEQ ID NO: 386 - DNA, 32 bp; single-stranded, linear
  oligonucleotide primer
gagggtatgacaagagcaattcctaaatccag

SEQ ID NO: 387 - DNA, 27 bp; single-stranded, linear
  oligonucleotide primer
tctggctctggacaggcactatctggg

SEQ ID NO: 388 - DNA, 30 bp; single-stranded, linear
  oligonucleotide primer
agtgggttaaagatgtgacgttcaacggga

SEQ ID NO: 389 - DNA, 30 bp; single-stranded, linear
  oligonucleotide primer
tttcagaagtggctcgcatcagtagcttgg

SEQ ID NO: 390 - DNA, 32 bp; single-stranded, linear
  oligonucleotide primer
gagtaggtaaagagcaaatgggttgacacaag

SEQ ID NO: 391 - DNA, 26 bp; single-stranded, linear
  oligonucleotide primer
gagagccaagcctacagcgggtccca

SEQ ID NO: 392 - DNA, 28 bp; single-stranded, linear
  oligonucleotide primer
agttgtgggtaaagcaggcaagtgggcc

SEQ ID NO: 393 - DNA, 30 bp; single-stranded, linear
  oligonucleotide primer
agtgtacctgcccactcagatgctagtgaa

SEQ ID NO: 394 - DNA, 29 bp; single-stranded, linear
  oligonucleotide primer
cacatcgctcttgctggtgtagacacggt

SEQ ID NO: 395 - DNA, 26 bp; single-stranded, linear
  oligonucleotide primer
agtagtggccctgacttccggtcggc

SEQ ID NO: 396 - DNA, 26 bp; single-stranded, linear
  oligonucleotide primer
ggtgtaaccacctctcgcaaggccac

SEQ ID NO: 397 - DNA, 28 bp; single-stranded, linear
  oligonucleotide primer
gggaaatcgccagcttcgataaggccaa

SEQ ID NO: 398 - DNA, 29 bp; single-stranded, linear
  oligonucleotide primer
gcaaaccggagaatttggcagtccgattg

SEQ ID NO: 399 - DNA, 29 bp; single-stranded, linear
  oligonucleotide primer
gtaccggcccggttagtatcatcagatcg

SEQ ID NO: 400 - DNA, 32 bp; single-stranded, linear
  oligonucleotide primer
ggcttgttacaggcaaattcacttgccacaag

SEQ ID NO: 401 - DNA, 32 bp; single-stranded, linear
  oligonucleotide primer
ttatctgtctagtggttcttgtgggtattctc

SEQ ID NO: 402 - DNA, 32 bp; single-stranded, linear
  oligonucleotide primer
ggcattgatataatcagtcagtttgccatcct

SEQ ID NO: 403 - DNA, 27 bp; single-stranded, linear
  oligonucleotide primer
atctgggccgcctccaaggtgaatggc

SEQ ID NO: 404 - DNA, 29 bp; single-stranded, linear
  oligonucleotide primer
gatccgtaacagcatccgccagtttgctg

SEQ ID NO: 405 - DNA, 28 bp; single-stranded, linear
  oligonucleotide primer
ggactccagaactaccaccgtctgcacg

SEQ ID NO: 406 - DNA, 28 bp; single-stranded, linear
  oligonucleotide primer
gtgaaccgagatcgcgtcattgcagtcc

SEQ ID NO: 407 - DNA, 32 bp; single-stranded, linear
  oligonucleotide primer
aaagttgtaagctgcgaggtcttcatcacaga

SEQ ID NO: 408 - DNA, 32 bp; single-stranded, linear
  oligonucleotide primer
gattattggcctctactaacttgcactgtcgt

SEQ ID NO: 409 - DNA, 27 bp; single-stranded, linear
  oligonucleotide primer
gtagctggcaagcggtcttaccggctc

SEQ ID NO: 410 - DNA, 29 bp; single-stranded, linear
  oligonucleotide primer
ggatttgtctgctgcccagtgggtagaga

SEQ ID NO: 411 - DNA, 23 bp; single-stranded, linear
  oligonucleotide primer
cctcccacctgcccctcagttcc

SEQ ID NO: 412 - DNA, 23 bp; single-stranded, linear
  oligonucleotide primer
gagctgcgagtgctacctagccc

SEQ ID NO: 413 - DNA, 32 bp; single-stranded, linear
  oligonucleotide primer
ttcctgttactgagaactcaaagggttacaag

SEQ ID NO: 414 - DNA, 32 bp; single-stranded, linear
  oligonucleotide primer
gttaatcccaaggccattagttacaacatagc

SEQ ID NO: 415 - DNA, 26 bp; single-stranded, linear
  oligonucleotide primer
ctggccgccaggaacgtgcttgtcac

SEQ ID NO: 416 - DNA, 29 bp; single-stranded, linear
  oligonucleotide primer
gtaggtgtgaggacattccgaaacacggc

SEQ ID NO: 417 - DNA, 27 bp; single-stranded, linear
  oligonucleotide primer
agacgtggcacattcctgccgacaccc

SEQ ID NO: 418 - DNA, 28 bp; single-stranded, linear
  oligonucleotide primer
aagtggtaggtggacaggaccgtagacc

SEQ ID NO: 419 - DNA, 28 bp; single-stranded, linear
  oligonucleotide primer
tcctccaccagcaatgcagagtgtgact

SEQ ID NO: 420 - DNA, 30 bp; single-stranded, linear
  oligonucleotide primer
cgtcccattcacaagcacagactttccatc

SEQ ID NO: 421 - DNA, 28 bp; single-stranded, linear
  oligonucleotide primer
cagcctcccaagcaactgggattcatcc

SEQ ID NO: 422 - DNA, 30 bp; single-stranded, linear
  oligonucleotide primer
ttggcaacatagcaataccgtctccgcaaa

SEQ ID NO: 423 - DNA, 30 bp; single-stranded, linear
  oligonucleotide primer
ggtatgtttgggagactgctgagtcaaccc

SEQ ID NO: 424 - DNA, 32 bp; single-stranded, linear
  oligonucleotide primer
aacaatatgagcatcaaggacatctgcgaagc

SEQ ID NO: 425 - DNA, 32 bp; single-stranded, linear
  oligonucleotide primer
agagactttgactctccagaaagctcatctca

SEQ ID NO: 426 - DNA, 32 bp; single-stranded, linear
  oligonucleotide primer
tgacctggtgaacccttcaaggttaaatacac

SEQ ID NO: 427 - DNA, 25 bp; single-stranded, linear
  oligonucleotide primer
aaagggctgtcacccggcttggccc

SEQ ID NO: 428 - DNA, 26 bp; single-stranded, linear
  oligonucleotide primer
gcgacagtcttgagccgctccatcca

SEQ ID NO: 429 - DNA, 32 bp; single-stranded, linear
  oligonucleotide primer
gtgaagcaaatagcatttccatctggtactcc

SEQ ID NO: 430 - DNA, 30 bp; single-stranded, linear
  oligonucleotide primer
acatgattcaccaggccactgacaactgtc

SEQ ID NO: 431 - DNA, 25 bp; single-stranded, linear
  oligonucleotide primer
gctccatgctgtgcctgcggccaac

SEQ ID NO: 432 - DNA, 25 bp; single-stranded, linear
  oligonucleotide primer
cttgaggtagggcagcccgtcgggc

SEQ ID NO: 433 - DNA, 30 bp; single-stranded, linear
  oligonucleotide primer
gcagagacatgactcagcctgttccatgaa

SEQ ID NO: 434 - DNA, 30 bp; single-stranded, linear
  oligonucleotide primer
atactgacagccagtgagacttggtgcagt

SEQ ID NO: 435 - DNA, 32 bp; single-stranded, linear
  oligonucleotide primer
ttgagaagtatttccatccagtgctacttgtg

SEQ ID NO: 436 - DNA, 32 bp; single-stranded, linear
  oligonucleotide primer
cccattagaagacaaactgttgtttgctagga

SEQ ID NO: 437 - DNA, 27 bp; single-stranded, linear
  oligonucleotide primer
tcacctcaaggagcctgagcacccgtc

SEQ ID NO: 438 - DNA, 30 bp; single-stranded, linear
  oligonucleotide primer
ccctgaaccaagaccgttcttcacgagaag

SEQ ID NO: 439 - DNA, 28 bp; single-stranded, linear
  oligonucleotide primer
gagggtcagacgcctgaggaacccttac

SEQ ID NO: 440 - DNA, 28 bp; single-stranded, linear
  oligonucleotide primer
taggctttgcccaggttgactggtcctg

SEQ ID NO: 441 - DNA, 26 bp; single-stranded, linear
  oligonucleotide primer
cctcggatgctggagatgactcaaca

SEQ ID NO: 442 - DNA, 26 bp; single-stranded, linear
  oligonucleotide primer
tcacaagccttctggcggttcgtaca

SEQ ID NO: 443 - DNA, 30 bp; single-stranded, linear
  oligonucleotide primer
aagagatgtctgaatccagaatcgaaggcc

SEQ ID NO: 444 - DNA, 30 bp; single-stranded, linear
  oligonucleotide primer
cctcagtagagcttacattatagtgccagg

SEQ ID NO: 445 - DNA, 28 bp; single-stranded, linear
  oligonucleotide primer
gctcctcggctttgacagagtgcaagac

SEQ ID NO: 446 - DNA, 30 bp; single-stranded, linear
  oligonucleotide primer
gcatttgtgtccaggtcctccatgatgtgt

SEQ ID NO: 447 - DNA, 28 bp; single-stranded, linear
  oligonucleotide primer
gggcaagttccgtgggcatcatgttgac

SEQ ID NO: 448 - DNA, 31 bp; single-stranded, linear
  oligonucleotide primer
ccagtaactcagctactctttgtggctttct

SEQ ID NO: 449 - DNA, 25 bp; single-stranded, linear
  oligonucleotide primer
gcatccgggacctccagcgactcct

SEQ ID NO: 450 - DNA, 25 bp; single-stranded, linear
  oligonucleotide primer
aggcttgtggtcgcgcaggcgcact

SEQ ID NO: 451 - DNA, 27 bp; single-stranded, linear
  oligonucleotide primer
cccactgcgcccaaaccgaagtcatag

SEQ ID NO: 452 - DNA, 28 bp; single-stranded, linear
  oligonucleotide primer
ttctgttcctataagggcagggcctcct

SEQ ID NO: 453 - DNA, 25 bp; single-stranded, linear
  oligonucleotide primer
gatggctcccgacacaagcgccagg

SEQ ID NO: 454 - DNA, 28 bp; single-stranded, linear
  oligonucleotide primer
agggttgttccagggcgctatttcagag

SEQ ID NO: 455 - DNA, 30 bp; single-stranded, linear
  oligonucleotide primer
gctaatgtgaccagttgtctctgtttgggc

SEQ ID NO: 456 - DNA, 30 bp; single-stranded, linear
  oligonucleotide primer
cagaagactcttcagaaatgtcagcgcgtt

SEQ ID NO: 457 - DNA, 29 bp; single-stranded, linear
  oligonucleotide primer
ccaggacctatcagaagctgtcgtacctg

SEQ ID NO: 458 - DNA, 28 bp; single-stranded, linear
  oligonucleotide primer
gacgatgccacagacaagggttcccacg

SEQ ID NO: 459 - DNA, 32 bp; single-stranded, linear
  oligonucleotide primer
gaataaatccttgggagtcattaccacgcctt

SEQ ID NO: 460 - DNA, 32 bp; single-stranded, linear
  oligonucleotide primer
ctgaatcagaatctccattcaaaccaggtccc

SEQ ID NO: 461 - DNA, 28 bp; single-stranded, linear
  oligonucleotide primer
cagtgctccaagcccagtgtcatcttcc

SEQ ID NO: 462 - DNA, 28 bp; single-stranded, linear
  oligonucleotide primer
ttgtcagtctggtggctttggtgccatc

SEQ ID NO: 463 - DNA, 31 bp; single-stranded, linear
  oligonucleotide primer
aaggagtttgccagaagactcgctcaattcc

SEQ ID NO: 464 - DNA, 30 bp; single-stranded, linear
  oligonucleotide primer
cacgtaatcctccatgagatacaagggcgg

SEQ ID NO: 465 - DNA, 27 bp; single-stranded, linear
  oligonucleotide primer
actgaactgcgctgccagtgcttgcag

SEQ ID NO: 466 - DNA, 30 bp; single-stranded, linear
  oligonucleotide primer
cctaagtgatgctcaaacacattaggcgca

SEQ ID NO: 467 - DNA, 26 bp; single-stranded, linear
  oligonucleotide primer
ggccctgctacctgttcttgggcctc

SEQ ID NO: 468 - DNA, 30 bp; single-stranded, linear
  oligonucleotide primer
ccagtacaagcaaatggcaaagtgtgaggg

SEQ ID NO: 469 - DNA, 29 bp; single-stranded, linear
  oligonucleotide primer
tttctgggaaccggcacacccttaaccac

SEQ ID NO: 470 - DNA, 32 bp; single-stranded, linear
  oligonucleotide primer
ttgaaagtcttgatgatgaggccatagcacag

SEQ ID NO: 471 - DNA, 28 bp; single-stranded, linear
  oligonucleotide primer
tgcacagagttcactgaaacggaatgcc

SEQ ID NO: 472 - DNA, 28 bp; single-stranded, linear
  oligonucleotide primer
cagacaacatcagtcttgtttgtgcctg

SEQ ID NO: 473 - DNA, 24 bp; single-stranded, linear
  oligonucleotide primer
ggagggcacccgcagctccgtctc

SEQ ID NO: 474 - DNA, 26 bp; single-stranded, linear
  oligonucleotide primer
gcactcggagtaattcacgcgggcgg

SEQ ID NO: 475 - DNA, 25 bp; single-stranded, linear
  oligonucleotide primer
gttcaggaacccgcgaccgctcgca

SEQ ID NO: 476 - DNA, 28 bp; single-stranded, linear
  oligonucleotide primer
ctgtgggcctatggcgaacacttgcaga

SEQ ID NO: 477 - DNA, 32 bp; single-stranded, linear
  oligonucleotide primer
gtctacttgaatgtgaccactgacaatacctc

SEQ ID NO: 478 - DNA, 29 bp; single-stranded, linear
  oligonucleotide primer
gtgcctagtaggctcaaggcaatcttggg

SEQ ID NO: 479 - DNA, 28 bp; single-stranded, linear
  oligonucleotide primer
aacatgacttccaagctggccgtggctc

SEQ ID NO: 480 - DNA, 28 bp; single-stranded, linear
  oligonucleotide primer
gcgcagtgtggtccactctcaatcactc

SEQ ID NO: 481 - DNA, 26 bp; single-stranded, linear
  oligonucleotide primer
gtacggaccaactccacctttgtcca

SEQ ID NO: 482 - DNA, 26 bp; single-stranded, linear
  oligonucleotide primer
tcagactttgctgggacctcgtgctt

SEQ ID NO: 483 - DNA, 26 bp; single-stranded, linear
  oligonucleotide primer
ccttctgtacgagatgctcattggcc

SEQ ID NO: 484 - DNA, 27 bp; single-stranded, linear
  oligonucleotide primer
cgatgaggttcttgtcgctgtaggaga

SEQ ID NO: 485 - DNA, 26 bp; single-stranded, linear
  oligonucleotide primer
tccaggcagggtagtggagtgattct

SEQ ID NO: 486 - DNA, 26 bp; single-stranded, linear
  oligonucleotide primer
aaagccaaggctgtcttgtcgtaggc

SEQ ID NO: 487 - DNA, 26 bp; single-stranded, linear
  oligonucleotide primer
ttccaaccagtggaattggtcagccc

SEQ ID NO: 488 - DNA, 26 bp; single-stranded, linear
  oligonucleotide primer
gactgcggcaaagcacaccgggtaaa

SEQ ID NO: 489 - DNA, 28 bp; single-stranded, linear
  oligonucleotide primer
tttccagatgtccctggtagatttggga

SEQ ID NO: 490 - DNA, 28 bp; single-stranded, linear
  oligonucleotide primer
ggcccaatggagagctgtcatctttaac

SEQ ID NO: 491 - DNA, 26 bp; single-stranded, linear
  oligonucleotide primer
gcagccaaagtacaaagagcgccgag

SEQ ID NO: 492 - DNA, 26 bp; single-stranded, linear
  oligonucleotide primer
gctgtgactggctgggcaattccatg

SEQ ID NO: 493 - DNA, 28 bp; single-stranded, linear
  oligonucleotide primer
ttattgtagacagtgccaccgcccttta

SEQ ID NO: 494 - DNA, 28 bp; single-stranded, linear
  oligonucleotide primer
tcgtagatttggcagattctggtttccc

SEQ ID NO: 495 - DNA, 26 bp; single-stranded, linear
  oligonucleotide primer
ggctcctgaatatcagtcactgttcg

SEQ ID NO: 496 - DNA, 26 bp; single-stranded, linear
  oligonucleotide primer
accctaacgccgccatcactaagaga

SEQ ID NO: 497 - DNA, 23 bp; single-stranded, linear
  oligonucleotide primer
ccggcaagacagcgagcggtgcg

SEQ ID NO: 498 - DNA, 23 bp; single-stranded, linear
  oligonucleotide primer
ggcgctgatctcgccgttgaggg

SEQ ID NO: 499 - DNA, 27 bp; single-stranded, linear
  oligonucleotide primer
agctggtgcatcacatcaacaacgagc

SEQ ID NO: 500 - DNA, 28 bp; single-stranded, linear
  oligonucleotide primer
ctgggatcttgcagatgtagggtttctc

SEQ ID NO: 501 - DNA, 26 bp; single-stranded, linear
  oligonucleotide primer
ctacagtcactgcccagttacccaca

SEQ ID NO: 502 - DNA, 28 bp; single-stranded, linear
  oligonucleotide primer
gggcggtgtagaatcagagtcattctga

SEQ ID NO: 503 - DNA, 25 bp; single-stranded, linear
  oligonucleotide primer
actccgcagcgtctgaagttgctgg

SEQ ID NO: 504 - DNA, 28 bp; single-stranded, linear
  oligonucleotide primer
ggagatgccttggaaatccgctttgttc

SEQ ID NO: 505 - DNA, 24 bp; single-stranded, linear
  oligonucleotide primer
ggtggacattgcctgcggcatgga

SEQ ID NO: 506 - DNA, 28 bp; single-stranded, linear
  oligonucleotide primer
cccaagatgttctccagttccattcgca

SEQ ID NO: 507 - DNA, 26 bp; single-stranded, linear
  oligonucleotide primer
ttcagagccaacaggagcctatccca

SEQ ID NO: 508 - DNA, 27 bp; single-stranded, linear
  oligonucleotide primer
cgactttaaggcacagtcaggatgggt

SEQ ID NO: 509 - DNA, 25 bp; single-stranded, linear
  oligonucleotide primer
actgctcagagtggcaacacggagc

SEQ ID NO: 510 - DNA, 26 bp; single-stranded, linear
  oligonucleotide primer
ggtgcttgggccagtgttgtagacct

SEQ ID NO: 511 - DNA, 26 bp; single-stranded, linear
  oligonucleotide primer
atcggaacacgctggctccatatcgt

SEQ ID NO: 512 - DNA, 26 bp; single-stranded, linear
  oligonucleotide primer
ccctcggcaactttacaagactccct

SEQ ID NO: 513 - DNA, 26 bp; single-stranded, linear
  oligonucleotide primer
agccgctggaaccaagacacaatgga

SEQ ID NO: 514 - DNA, 26 bp; single-stranded, linear
  oligonucleotide primer
ggtttacagtacctgcggtgttctcc

SEQ ID NO: 515 - DNA, 24 bp; single-stranded, linear
  oligonucleotide primer
agtcttcaagccacgagcggaggg

SEQ ID NO: 516 - DNA, 25 bp; single-stranded, linear
  oligonucleotide primer
gagggcgtcactgtagtccacgtca

SEQ ID NO: 517 - DNA, 24 bp; single-stranded, linear
  oligonucleotide primer
aggataggcacagtggaccgggca

SEQ ID NO: 518 - DNA, 26 bp; single-stranded, linear
  oligonucleotide primer
gtcccacgggcctgttgggattgttt

SEQ ID NO: 519 - DNA, 26 bp; single-stranded, linear
  oligonucleotide primer
agctgctaacctgtgccaaacctcca

SEQ ID NO: 520 - DNA, 26 bp; single-stranded, linear
  oligonucleotide primer
ggagatgtgatggtgacagggtgtgc

SEQ ID NO: 521 - DNA, 26 bp; single-stranded, linear
  oligonucleotide primer
ccctgtggaatgttgggtctcactct

SEQ ID NO: 522 - DNA, 25 bp; single-stranded, linear
  oligonucleotide primer
cagggaccttagcccgattcatgcc

SEQ ID NO: 523 - DNA, 24 bp; single-stranded, linear
  oligonucleotide primer
ccggcggtacaagaacaacgaggc

SEQ ID NO: 524 - DNA, 23 bp; single-stranded, linear
  oligonucleotide primer
gatagggtccctgacgtgccggg

SEQ ID NO: 525 - DNA, 26 bp; single-stranded, linear
  oligonucleotide primer
acactccgtggcccaccctttgttac

SEQ ID NO: 526 - DNA, 26 bp; single-stranded, linear
  oligonucleotide primer
ggtggaacaggaggctttaggaccga

SEQ ID NO: 527 - DNA, 24 bp; single-stranded, linear
  oligonucleotide primer
gggagcttcgtgtcctgtatggcc

SEQ ID NO: 528 - DNA, 28 bp; single-stranded, linear
  oligonucleotide primer
agtctgtatttcttgatcttccgctggc

SEQ ID NO: 529 - DNA, 26 bp; single-stranded, linear
  oligonucleotide primer
ccctgaccatcctgtactatgttggg

SEQ ID NO: 530 - DNA, 26 bp; single-stranded, linear
  oligonucleotide primer
gggtagcccaaatcccattgccacac

SEQ ID NO: 531 - DNA, 24 bp; single-stranded, linear
  oligonucleotide primer
tctgaagaccaccctcatcgccgg

SEQ ID NO: 532 - DNA, 26 bp; single-stranded, linear
  oligonucleotide primer
caactctatgagcacccacactcctc

SEQ ID NO: 533 - DNA, 24 bp; single-stranded, linear
  oligonucleotide primer
ctcccatgtttccacccggcaccc

SEQ ID NO: 534 - DNA, 25 bp; single-stranded, linear
  oligonucleotide primer
ggcgcggaggctcatgtctgtaatc

SEQ ID NO: 535 - DNA, 28 bp; single-stranded, linear
  oligonucleotide primer
tgcccatttgatcgacaagtaacagacc

SEQ ID NO: 536 - DNA, 28 bp; single-stranded, linear
  oligonucleotide primer
acatgagtgggctagtttgacaaccttc

SEQ ID NO: 537 - DNA, 28 bp; single-stranded, linear
  oligonucleotide primer
gggttgggtccaactgtaattgtctgtc

SEQ ID NO: 538 - DNA, 28 bp; single-stranded, linear
  oligonucleotide primer
tccataaacacaggcaacgtgcctaact

SEQ ID NO: 539 - DNA, 26 bp; single-stranded, linear
  oligonucleotide primer
agctggagctgatgtttgggtgccag

SEQ ID NO: 540 - DNA, 26 bp; single-stranded, linear
  oligonucleotide primer
cttagacgccagcagcatgggttggt

SEQ ID NO: 541 - DNA, 27 bp; single-stranded, linear
  oligonucleotide primer
ccggaaacctgctaacgatagagactc

SEQ ID NO: 542 - DNA, 26 bp; single-stranded, linear
  oligonucleotide primer
tggtgttactgatgctccggttcctc

SEQ ID NO: 543 - DNA, 24 bp; single-stranded, linear
  oligonucleotide primer
gactgtctacacctgcaccgggca

SEQ ID NO: 544 - DNA, 25 bp; single-stranded, linear
  oligonucleotide primer
gaatggccctcagagcatctaggcc

SEQ ID NO: 545 - DNA, 26 bp; single-stranded, linear
  oligonucleotide primer
acctattcgtagtaggtgcttggcgg

SEQ ID NO: 546 - DNA, 28 bp; single-stranded, linear
  oligonucleotide primer
agctcatacagccttccacgaacttcaa

SEQ ID NO: 547 - DNA, 23 bp; single-stranded, linear
  oligonucleotide primer
tgcaggtcctggtgggtcagccc

SEQ ID NO: 548 - DNA, 23 bp; single-stranded, linear
  oligonucleotide primer
accagcggtgtgggactggtccc

SEQ ID NO: 549 - DNA, 24 bp; single-stranded, linear
  oligonucleotide primer
actaggaccagactgcacccggca

SEQ ID NO: 550 - DNA, 25 bp; single-stranded, linear
  oligonucleotide primer
ccctcgtcactcccaatactcggca

SEQ ID NO: 551 - DNA, 25 bp; single-stranded, linear
  oligonucleotide primer
ggagcaggagcttctcgacttcacc

SEQ ID NO: 552 - DNA, 27 bp; single-stranded, linear
  oligonucleotide primer
gcattgactcaggtcccagttgctctt

SEQ ID NO: 553 - DNA, 28 bp; single-stranded, linear
  oligonucleotide primer
ctagagaatcccagaatgcgaaactcag

SEQ ID NO: 554 - DNA, 27 bp; single-stranded, linear
  oligonucleotide primer
aggtaggtctttgtagccaatgttacc

SEQ ID NO: 555 - DNA, 27 bp; single-stranded, linear
  oligonucleotide primer
ctctttgatttggtgtgccggactctg

SEQ ID NO: 556 - DNA, 26 bp; single-stranded, linear
  oligonucleotide primer
caccatacttggcctggacggcgtaa

SEQ ID NO: 557 - DNA, 27 bp; single-stranded, linear
  oligonucleotide primer
cctggaagcctagaaatgggactgttg

SEQ ID NO: 558 - DNA, 28 bp; single-stranded, linear
  oligonucleotide primer
atactttgctctgggcagttgtgagaca

SEQ ID NO: 559 - DNA, 28 bp; single-stranded, linear
  oligonucleotide primer
taccctctacagccttatgacgaaatgc

SEQ ID NO: 560 - DNA, 28 bp; single-stranded, linear
  oligonucleotide primer
caatccctcgcaggtccaatactgtaga

SEQ ID NO: 561 - DNA, 24 bp; single-stranded, linear
  oligonucleotide primer
agaagatcggcatgggtcggcctg

SEQ ID NO: 562 - DNA, 25 bp; single-stranded, linear
  oligonucleotide primer
ggtttcggtggtcgagcgagtgcat

SEQ ID NO: 563 - DNA, 24 bp; single-stranded, linear
  oligonucleotide primer
ttctccacaccttgagggctcggg

SEQ ID NO: 564 - DNA, 24 bp; single-stranded, linear
  oligonucleotide primer
gcagaactggcagcggtttcgccg

SEQ ID NO: 565 - DNA, 26 bp; single-stranded, linear
  oligonucleotide primer
cctactgttcgttcaccaacggcgag

SEQ ID NO: 566 - DNA, 26 bp; single-stranded, linear
  oligonucleotide primer
ctgagagtcaaaggcacggcacactc

SEQ ID NO: 567 - DNA, 28 bp; single-stranded, linear
  oligonucleotide primer
atgggatgcagaactctggcaatgagat

SEQ ID NO: 568 - DNA, 28 bp; single-stranded, linear
  oligonucleotide primer
cagtgttgaatggctctgctattgtgac

SEQ ID NO: 569 - DNA, 28 bp; single-stranded, linear
  oligonucleotide primer
ctgcgcttaccacactgtgatcctaaaa

SEQ ID NO: 570 - DNA, 28 bp; single-stranded, linear
  oligonucleotide primer
gccaataccaacagtcccgtcaatcaca

SEQ ID NO: 571 - DNA, 24 bp; single-stranded, linear
  oligonucleotide primer
ccttcatcgccatcaagccggacg

SEQ ID NO: 572 - DNA, 27 bp; single-stranded, linear
  oligonucleotide primer
gctttgaatctgctggattggtctccc

SEQ ID NO: 573 - DNA, 24 bp; single-stranded, linear
  oligonucleotide primer
ccctgtcctgatggtcagctccct

SEQ ID NO: 574 - DNA, 26 bp; single-stranded, linear
  oligonucleotide primer
ctcaaacgctggtgttaggcacaggg

SEQ ID NO: 575 - DNA, 26 bp; single-stranded, linear
  oligonucleotide primer
tctcggtggactctcagttcaaccac

SEQ ID NO: 576 - DNA, 28 bp; single-stranded, linear
  oligonucleotide primer
atccgttagccagcctaattgtgtttgg

SEQ ID NO: 577 - DNA, 24 bp; single-stranded, linear
  oligonucleotide primer
gtagacctggcccaccagggtgta

SEQ ID NO: 578 - DNA, 26 bp; single-stranded, linear
  oligonucleotide primer
gtctcggatctcccaggcaaacatgg

SEQ ID NO: 579 - DNA, 28 bp; single-stranded, linear
  oligonucleotide primer
tactgcaacacttgcgtcatctagtgtg

SEQ ID NO: 580 - DNA, 28 bp; single-stranded, linear
  oligonucleotide primer
gtacaagttggagatgccggtgtcagtt

SEQ ID NO: 581 - DNA, 25 bp; single-stranded, linear
  oligonucleotide primer
atggctctggacgtgaagtctcggg

SEQ ID NO: 582 - DNA, 26 bp; single-stranded, linear
  oligonucleotide primer
gatcatgggcctcaggtgaaactccg

SEQ ID NO: 583 - DNA, 26 bp; single-stranded, linear
  oligonucleotide primer
gtaattcgtggcctgggagttcagct

SEQ ID NO: 584 - DNA, 28 bp; single-stranded, linear
  oligonucleotide primer
tggtgagtggcttccaaatgactgtttg

SEQ ID NO: 585 - DNA, 24 bp; single-stranded, linear
  oligonucleotide primer
gtggttggtgccaggcgatcttcc

SEQ ID NO: 586 - DNA, 28 bp; single-stranded, linear
  oligonucleotide primer
gcgtggagtccttataggaatcctcgtt

SEQ ID NO: 587 - DNA, 28 bp; single-stranded, linear
  oligonucleotide primer
cacaattaggtctcactctggttaggca

SEQ ID NO: 588 - DNA, 28 bp; single-stranded, linear
  oligonucleotide primer
ggtagatcaatccgtgagacatttcagg

SEQ ID NO: 589 - DNA, 25 bp; single-stranded, linear
  oligonucleotide primer
gtgcccaggcatagggttagctcag

SEQ ID NO: 590 - DNA, 28 bp; single-stranded, linear
  oligonucleotide primer
gcatattgggtgggttgactagatgtcg

SEQ ID NO: 591 - DNA, 24 bp; single-stranded, linear
  oligonucleotide primer
gatccgcgtcgtgaaggcgttccg

SEQ ID NO: 592 - DNA, 23 bp; single-stranded, linear
  oligonucleotide primer
gcccggaaagcgggtgacagcgg

SEQ ID NO: 593 - DNA, 26 bp; single-stranded, linear
  oligonucleotide primer
ccacttcaccactgctatcaacacgg

SEQ ID NO: 594 - DNA, 28 bp; single-stranded, linear
  oligonucleotide primer
cagcaaatcttggcgatgagtcactcaa

SEQ ID NO: 595 - DNA, 24 bp; single-stranded, linear
  oligonucleotide primer
tgcagaggatgattgccgccgtgg

SEQ ID NO: 596 - DNA, 25 bp; single-stranded, linear
  oligonucleotide primer
cacccaaccaccctggtcttggatc

SEQ ID NO: 597 - DNA, 25 bp; single-stranded, linear
  oligonucleotide primer
agcagggcacacctatgatcgctcc

SEQ ID NO: 598 - DNA, 24 bp; single-stranded, linear
  oligonucleotide primer
cggccctcatccaccgagacctca

SEQ ID NO: 599 - DNA, 28 bp; single-stranded, linear
  oligonucleotide primer
tacatttcaagctctccagcatccgtgg

SEQ ID NO: 600 - DNA, 28 bp; single-stranded, linear
  oligonucleotide primer
ctggaatagctttcatgtcctcgttgcc

SEQ ID NO: 601 - DNA, 28 bp; single-stranded, linear
  oligonucleotide primer
gtcagtgcttgctaacttcagtcaacct

SEQ ID NO: 602 - DNA, 28 bp; single-stranded, linear
  oligonucleotide primer
aacagacaagctgatggaaacgtcgtac

SEQ ID NO: 603 - DNA, 25 bp; single-stranded, linear
  oligonucleotide primer
ctgcgggacatagaacaggtgccac

SEQ ID NO: 604 - DNA, 26 bp; single-stranded, linear
  oligonucleotide primer
gactcttagacgttccggttcacggg

SEQ ID NO: 605 - DNA, 24 bp; single-stranded, linear
  oligonucleotide primer
tggcggctggacctggtcatggtg

SEQ ID NO: 606 - DNA, 27 bp; single-stranded, linear
  oligonucleotide primer
gatactctcaccagctccgtcacattc

SEQ ID NO: 607 - DNA, 23 bp; single-stranded, linear
  oligonucleotide primer
ggaggcccggctcttcgccatgc

SEQ ID NO: 608 - DNA, 26 bp; single-stranded, linear
  oligonucleotide primer
gtcggtgatcttcagggtcttgtgct

SEQ ID NO: 609 - DNA, 28 bp; single-stranded, linear
  oligonucleotide primer
cctccagtatctgcacaggaacttcatt

SEQ ID NO: 610 - DNA, 27 bp; single-stranded, linear
  oligonucleotide primer
caagtcgatctggtggatctcggaagt

SEQ ID NO: 611 - DNA, 26 bp; single-stranded, linear
  oligonucleotide primer
ggctgtgaaggacctgatgccatgta

SEQ ID NO: 612 - DNA, 26 bp; single-stranded, linear
  oligonucleotide primer
tcggtggagctgttagtgtagcgaac

SEQ ID NO: 613 - DNA, 28 bp; single-stranded, linear
  oligonucleotide primer
acaccaatgccagcatcacattgtatgg

SEQ ID NO: 614 - DNA, 26 bp; single-stranded, linear
  oligonucleotide primer
gctggtttgctctccgcagtgtagat

SEQ ID NO: 615 - DNA, 26 bp; single-stranded, linear
  oligonucleotide primer
aatgcaggtgtcctgagcaccacacc

SEQ ID NO: 616 - DNA, 27 bp; single-stranded, linear
  oligonucleotide primer
ggaaagtcagtcccagatgtagtggga

SEQ ID NO: 617 - DNA, 26 bp; single-stranded, linear
  oligonucleotide primer
ctcctcatggatgggtcaaacgtgac

SEQ ID NO: 618 - DNA, 26 bp; single-stranded, linear
  oligonucleotide primer
cagaccaatgccgactggtacttggg

SEQ ID NO: 619 - DNA, 28 bp; single-stranded, linear
  oligonucleotide primer
tctctgtgatcctgttcctcaacaagca

SEQ ID NO: 620 - DNA, 28 bp; single-stranded, linear
  oligonucleotide primer
aatgatgtcacggcagtcgttgaacaca

SEQ ID NO: 621 - DNA, 26 bp; single-stranded, linear
  oligonucleotide primer
tagccaatgtgggagcagcggtttgg

SEQ ID NO: 622 - DNA, 28 bp; single-stranded, linear
  oligonucleotide primer
ataagtacattcccaggcactgtcacgt

SEQ ID NO: 623 - DNA, 24 bp; single-stranded, linear
  oligonucleotide primer
gctctccggctacggcaagcatga

SEQ ID NO: 624 - DNA, 24 bp; single-stranded, linear
  oligonucleotide primer
gtcgggtgttcctggtcacggtcg

SEQ ID NO: 625 - DNA, 24 bp; single-stranded, linear
  oligonucleotide primer
ctctgctctacgtggtccatgcgg

SEQ ID NO: 626 - DNA, 26 bp; single-stranded, linear
  oligonucleotide primer
gagagtaaacacagcacccacgagca

SEQ ID NO: 627 - DNA, 24 bp; single-stranded, linear
  oligonucleotide primer
gcgccctttgagcagaacctctcc

SEQ ID NO: 628 - DNA, 28 bp; single-stranded, linear
  oligonucleotide primer
gcgccggttctgaaaccaaatcttgatc

SEQ ID NO: 629 - DNA, 26 bp; single-stranded, linear
  oligonucleotide primer
ctttccgtgtaaactcggctcagcgc

SEQ ID NO: 630 - DNA, 26 bp; single-stranded, linear
  oligonucleotide primer
gaaattggcccgtcccttgttgaagg

SEQ ID NO: 631 - DNA, 24 bp; single-stranded, linear
  oligonucleotide primer
tgctctgcaaccaggccggaacct

SEQ ID NO: 632 - DNA, 26 bp; single-stranded, linear
  oligonucleotide primer
cagtgacggcagggtcaaagtccttg

SEQ ID NO: 633 - DNA, 25 bp; single-stranded, linear
  oligonucleotide primer
atggagacgggtctgttgttgcccc

SEQ ID NO: 634 - DNA, 24 bp; single-stranded, linear
  oligonucleotide primer
gcacgttcccgtactggttctggg

SEQ ID NO: 635 - DNA, 25 bp; single-stranded, linear
  oligonucleotide primer
ccggccagtggatggtacaagttgc

SEQ ID NO: 636 - DNA, 28 bp; single-stranded, linear
  oligonucleotide primer
ctccacgtcatcatcctgaatcaccaca

SEQ ID NO: 637 - DNA, 25 bp; single-stranded, linear
  oligonucleotide primer
gacagcagtgggcagcaatgacacc

SEQ ID NO: 638 - DNA, 27 bp; single-stranded, linear
  oligonucleotide primer
cttctagctgagcctgatgctcttgag

SEQ ID NO: 639 - DNA, 26 bp; single-stranded, linear
  oligonucleotide primer
tattcaccctccacttcccgtctcag

SEQ ID NO: 640 - DNA, 27 bp; single-stranded, linear
  oligonucleotide primer
cagaagtaggacagagaacgctccgaa

SEQ ID NO: 641 - DNA, 25 bp; single-stranded, linear
  oligonucleotide primer
gtaccggaccatcaccaccgcatac

SEQ ID NO: 642 - DNA, 26 bp; single-stranded, linear
  oligonucleotide primer
cagatgacatccaccaggcgctcaaa

SEQ ID NO: 643 - DNA, 28 bp; single-stranded, linear
  oligonucleotide primer
gggatacagcaggacaagaacgattcag

SEQ ID NO: 644 - DNA, 29 bp; single-stranded, linear
  oligonucleotide primer
cttgagcaaatctggaggcttctaagaag

SEQ ID NO: 645 - DNA, 26 bp; single-stranded, linear
  oligonucleotide primer
tctagttccacaatgtccacgggcgg

SEQ ID NO: 646 - DNA, 27 bp; single-stranded, linear
  oligonucleotide primer
ggaatcaagctcctgaaccgctcttga

SEQ ID NO: 647 - DNA, 28 bp; single-stranded, linear
  oligonucleotide primer
aaacttcagatatgggatacggcagggc

SEQ ID NO: 648 - DNA, 28 bp; single-stranded, linear
  oligonucleotide primer
gcagacgtttccatgaacatgagtccat

SEQ ID NO: 649 - DNA, 26 bp; single-stranded, linear
  oligonucleotide primer
cggaccatcacaacagcctattaccg

SEQ ID NO: 650 - DNA, 26 bp; single-stranded, linear
  oligonucleotide primer
caaatggcatccaccaggcgctcaaa

SEQ ID NO: 651 - DNA, 26 bp; single-stranded, linear
  oligonucleotide primer
tcgggaaacaaggccgacctagcaaa

SEQ ID NO: 652 - DNA, 26 bp; single-stranded, linear
  oligonucleotide primer
tgtgggttcggtaaggtctactcctc

SEQ ID NO: 653 - DNA, 26 bp; single-stranded, linear
  oligonucleotide primer
gaaatgtccaggccagcagtaccact

SEQ ID NO: 654 - DNA, 28 bp; single-stranded, linear
  oligonucleotide primer
ctagagtatctgctttccacggcatcag

SEQ ID NO: 655 - DNA, 23 bp; single-stranded, linear
  oligonucleotide primer
gaagggcaaggctgccgtgcagg

SEQ ID NO: 656 - DNA, 26 bp; single-stranded, linear
  oligonucleotide primer
tgggatgagcttcactcaacgtggag

SEQ ID NO: 657 - DNA, 26 bp; single-stranded, linear
  oligonucleotide primer
ctagggctatggtgtggactgaatgg

SEQ ID NO: 658 - DNA, 28 bp; single-stranded, linear
  oligonucleotide primer
ctgagtgacagaacaagacaccgtctct

SEQ ID NO: 659 - DNA, 24 bp; single-stranded, linear
  oligonucleotide primer
gctgagcagcccagccaacctcag

SEQ ID NO: 660 - DNA, 24 bp; single-stranded, linear
  oligonucleotide primer
acacggcgcagcgtagaacggatc

SEQ ID NO: 661 - DNA, 29 bp; single-stranded, linear
  oligonucleotide primer
gatcctttgtcaacctcacagacaacaag

SEQ ID NO: 662 - DNA, 28 bp; single-stranded, linear
  oligonucleotide primer
gtagacatgctgctacctggttgcactt

SEQ ID NO: 663 - DNA, 26 bp; single-stranded, linear
  oligonucleotide primer
tcgagatgagtggtggcctcgtgaat

SEQ ID NO: 664 - DNA, 28 bp; single-stranded, linear
  oligonucleotide primer
ggaaagccctggctcaagcatgtcatat

SEQ ID NO: 665 - DNA, 27 bp; single-stranded, linear
  oligonucleotide primer
tgaaaccgcaacacccatcaccacttc

SEQ ID NO: 666 - DNA, 26 bp; single-stranded, linear
  oligonucleotide primer
accctcgcacagagcattcagtagga

SEQ ID NO: 667 - DNA, 26 bp; single-stranded, linear
  oligonucleotide primer
agcaggttacctggaggcggatcatc

SEQ ID NO: 668 - DNA, 26 bp; single-stranded, linear
  oligonucleotide primer
gagaagtgagtccgtccttacccatg

SEQ ID NO: 669 - DNA, 27 bp; single-stranded, linear
  oligonucleotide primer
agagggctcacaagacacatttgtgcc

SEQ ID NO: 670 - DNA, 28 bp; single-stranded, linear
  oligonucleotide primer
aggtgtagcagtccttggtcattgtcat

SEQ ID NO: 671 - DNA, 26 bp; single-stranded, linear
  oligonucleotide primer
aaactgcatcttggccctgttgcctg

SEQ ID NO: 672 - DNA, 28 bp; single-stranded, linear
  oligonucleotide primer
tctaggaacagcagcagaaatagcgaga

SEQ ID NO: 673 - DNA, 26 bp; single-stranded, linear
  oligonucleotide primer
caacagccagccacatccactacaga

SEQ ID NO: 674 - DNA, 28 bp; single-stranded, linear
  oligonucleotide primer
gcggttacagggcaatctttatgagcca

SEQ ID NO: 675 - DNA, 28 bp; single-stranded, linear
  oligonucleotide primer
tactcaaccaagcggcagagattcttgg

SEQ ID NO: 676 - DNA, 28 bp; single-stranded, linear
  oligonucleotide primer
acgaagtaccctgcctaagcatcatttc

SEQ ID NO: 677 - DNA, 23 bp; single-stranded, linear
  oligonucleotide primer
cgcaggtcctcgcgttcgggctt

SEQ ID NO: 678 - DNA, 26 bp; single-stranded, linear
  oligonucleotide primer
cccgctctcatcgcagtcaggatcat

SEQ ID NO: 679 - DNA, 26 bp; single-stranded, linear
  oligonucleotide primer
agcaagggtacgctgggcaagttcac

SEQ ID NO: 680 - DNA, 27 bp; single-stranded, linear
  oligonucleotide primer
cctcgacttatgtcgggtagactcttc

SEQ ID NO: 681 - DNA, 23 bp; single-stranded, linear
  oligonucleotide primer
ccggcgctacctgggcgatgctt

SEQ ID NO: 682 - DNA, 24 bp; single-stranded, linear
  oligonucleotide primer
gccctcgtcccgctcaaactcctt

SEQ ID NO: 683 - DNA, 26 bp; single-stranded, linear
  oligonucleotide primer
aattcagcacccgcctcagtcaactg

SEQ ID NO: 684 - DNA, 26 bp; single-stranded, linear
  oligonucleotide primer
tgcagcgttcctgttccactcatagg

SEQ ID NO: 685 - DNA, 26 bp; single-stranded, linear
  oligonucleotide primer
gcaccaggagtgccaaggattgaaga

SEQ ID NO: 686 - DNA, 27 bp; single-stranded, linear
  oligonucleotide primer
ctagtgggtgctgtgcgaatctggtat

SEQ ID NO: 687 - DNA, 25 bp; single-stranded, linear
  oligonucleotide primer
catgttcaccctggaggacacgctg

SEQ ID NO: 688 - DNA, 28 bp; single-stranded, linear
  oligonucleotide primer
tccattgagcatcacatggaccacatca

SEQ ID NO: 689 - DNA, 27 bp; single-stranded, linear
  oligonucleotide primer
ccgaaacgccgaatataatcccaagcg

SEQ ID NO: 690 - DNA, 28 bp; single-stranded, linear
  oligonucleotide primer
ctaaattgttggtgggtgagcacaaggc

SEQ ID NO: 691 - DNA, 28 bp; single-stranded, linear
  oligonucleotide primer
ttccaactgcacgagatccagtatcact

SEQ ID NO: 692 - DNA, 23 bp; single-stranded, linear
  oligonucleotide primer
gccgcccgacggagcaactgtac

SEQ ID NO: 693 - DNA, 23 bp; single-stranded, linear
  oligonucleotide primer
cccaggccctggaccgccaaaca

SEQ ID NO: 694 - DNA, 26 bp; single-stranded, linear
  oligonucleotide primer
gcgatacgagccacagacttaggacc

SEQ ID NO: 695 - DNA, 24 bp; single-stranded, linear
  oligonucleotide primer
tccagtctccagggccataggcag

SEQ ID NO: 696 - DNA, 26 bp; single-stranded, linear
  oligonucleotide primer
gaagccactcagcaccactaccacac

SEQ ID NO: 697 - DNA, 23 bp; single-stranded, linear
  oligonucleotide primer
gcgagggcaacgtcagggtcagc

SEQ ID NO: 698 - DNA, 24 bp; single-stranded, linear
  oligonucleotide primer
ccggtggtgaaggcgtagccgttg

SEQ ID NO: 699 - DNA, 26 bp; single-stranded, linear
  oligonucleotide primer
gcctgcggtggcctggataacatttg

SEQ ID NO: 700 - DNA, 28 bp; single-stranded, linear
  oligonucleotide primer
catcacaagcaccagagacgaacagtct

SEQ ID NO: 701 - DNA, 24 bp; single-stranded, linear
  oligonucleotide primer
gcatcaagctgggcttcacgcagg

SEQ ID NO: 702 - DNA, 26 bp; single-stranded, linear
  oligonucleotide primer
aaggcgaagcggacgtttgtctcgat

SEQ ID NO: 703 - DNA, 26 bp; single-stranded, linear
  oligonucleotide primer
agctgtccacctagccagggactttg

SEQ ID NO: 704 - DNA, 27 bp; single-stranded, linear
  oligonucleotide primer
gagatgaggttgaagtgggtcaagcag

SEQ ID NO: 705 - DNA, 25 bp; single-stranded, linear
  oligonucleotide primer
gctcaagctcatcgacttcgggtcg

SEQ ID NO: 706 - DNA, 26 bp; single-stranded, linear
  oligonucleotide primer
ggcctatctgatggtctcagggccaa

SEQ ID NO: 707 - DNA, 28 bp; single-stranded, linear
  oligonucleotide primer
ttcactgttgccaaatggtggttcaggg

SEQ ID NO: 708 - DNA, 28 bp; single-stranded, linear
  oligonucleotide primer
ttggcatgagtgtcaactcagtgcaaag

SEQ ID NO: 709 - DNA, 25 bp; single-stranded, linear
  oligonucleotide primer
cgagggcaccttgcctgacaaacag

SEQ ID NO: 710 - DNA, 28 bp; single-stranded, linear
  oligonucleotide primer
ggcacactgatgtttaaggcttggacgt

SEQ ID NO: 711 - DNA, 28 bp; single-stranded, linear
  oligonucleotide primer
tgtatggtgactggaggtgctaacctag

SEQ ID NO: 712 - DNA, 26 bp; single-stranded, linear
  oligonucleotide primer
catgtcacccagggacccatttcacc

SEQ ID NO: 713 - DNA, 25 bp; single-stranded, linear
  oligonucleotide primer
ttgcacctcgtccatcgacaggtcc

SEQ ID NO: 714 - DNA, 26 bp; single-stranded, linear
  oligonucleotide primer
gggtagcggatggttcgagcatcatg

SEQ ID NO: 715 - DNA, 28 bp; single-stranded, linear
  oligonucleotide primer
cttggacaggtttcctgtgaacttgtgt

SEQ ID NO: 716 - DNA, 28 bp; single-stranded, linear
  oligonucleotide primer
ggaaatgacataaggccacgattgcagc

SEQ ID NO: 717 - DNA, 26 bp; single-stranded, linear
  oligonucleotide primer
gactgccgcatcatgggagtaagttc

SEQ ID NO: 718 - DNA, 28 bp; single-stranded, linear
  oligonucleotide primer
tgaggaatccaaacaacaaagtcccacc

SEQ ID NO: 719 - DNA, 28 bp; single-stranded, linear
  oligonucleotide primer
aaccattacagggagctgggacacttaa

SEQ ID NO: 720 - DNA, 28 bp; single-stranded, linear
  oligonucleotide primer
tttgttagaagccatccatagcacaccc

SEQ ID NO: 721 - DNA, 28 bp; single-stranded, linear
  oligonucleotide primer
tcaatcctgccattgtctcaccgtatga

SEQ ID NO: 722 - DNA, 28 bp; single-stranded, linear
  oligonucleotide primer
acgatgtaaagcaagcacattgccgtca

SEQ ID NO: 723 - DNA, 28 bp; single-stranded, linear
  oligonucleotide primer
tcttccacatgggtgcatttgtagctct

SEQ ID NO: 724 - DNA, 28 bp; single-stranded, linear
  oligonucleotide primer
ttggtactgcctagccctgtaagcattt

SEQ ID NO: 725 - DNA, 28 bp; single-stranded, linear
  oligonucleotide primer
ttccaagaagctaagggtgattcaccgc

SEQ ID NO: 726 - DNA, 28 bp; single-stranded, linear
  oligonucleotide primer
agtattatgctggcagaagtccatgagc

SEQ ID NO: 727 - DNA, 25 bp; single-stranded, linear
  oligonucleotide primer
tggcttccaggttcccatgatcccc

SEQ ID NO: 728 - DNA, 24 bp; single-stranded, linear
  oligonucleotide primer
ggcaagcgtaagggcgttcgtggg

SEQ ID NO: 729 - DNA, 25 bp; single-stranded, linear
  oligonucleotide primer
tgcgcccacaggtgctgtcttagtg

SEQ ID NO: 730 - DNA, 26 bp; single-stranded, linear
  oligonucleotide primer
gggtgaagtaactcaggccactctcc

SEQ ID NO: 731 - DNA, 25 bp; single-stranded, linear
  oligonucleotide primer
atgtaccaagcctgcccgactcagg

SEQ ID NO: 732 - DNA, 28 bp; single-stranded, linear
  oligonucleotide primer
tggccttaattcgagactcgtcgttgta

SEQ ID NO: 733 - DNA, 27 bp; single-stranded, linear
  oligonucleotide primer
tgttgcagggtattggctgactgctag

SEQ ID NO: 734 - DNA, 27 bp; single-stranded, linear
  oligonucleotide primer
gagtgaacctgtggctctatcaaccct

SEQ ID NO: 735 - DNA, 27 bp; single-stranded, linear
  oligonucleotide primer
catcctcaccagcctgtggatacattc

SEQ ID NO: 736 - DNA, 28 bp; single-stranded, linear
  oligonucleotide primer
gataggtagctgggcctcttaaacctaa

SEQ ID NO: 737 - DNA, 27 bp; single-stranded, linear
  oligonucleotide primer
ccggcagagaatttcaggaatagtggc

SEQ ID NO: 738 - DNA, 26 bp; single-stranded, linear
  oligonucleotide primer
tccacgattggtgagactagggtagg

SEQ ID NO: 739 - DNA, 23 bp; single-stranded, linear
  oligonucleotide primer
tcaggatgcctggaggcgtcggg

SEQ ID NO: 740 - DNA, 23 bp; single-stranded, linear
  oligonucleotide primer
tggtcttgcgggtgccgtccagg

SEQ ID NO: 741 - DNA, 28 bp; single-stranded, linear
  oligonucleotide primer
cctttcgccacagtatgtcagctacaac

SEQ ID NO: 742 - DNA, 28 bp; single-stranded, linear
  oligonucleotide primer
ctccttatccttcactgagtatttgccg

SEQ ID NO: 743 - DNA, 23 bp; single-stranded, linear
  oligonucleotide primer
gatcctccagccggagtcagcgg

SEQ ID NO: 744 - DNA, 28 bp; single-stranded, linear
  oligonucleotide primer
ggaagacacatcataggttggactccaa

SEQ ID NO: 745 - DNA, 26 bp; single-stranded, linear
  oligonucleotide primer
aaaggcacctgggaagtcatcgggat

SEQ ID NO: 746 - DNA, 27 bp; single-stranded, linear
  oligonucleotide primer
gctgaattgtcttccaggactctcagc

SEQ ID NO: 747 - DNA, 26 bp; single-stranded, linear
  oligonucleotide primer
tgcggatgaaggaccagtgtgacaag

SEQ ID NO: 748 - DNA, 25 bp; single-stranded, linear
  oligonucleotide primer
caccgtggtgacccgcagatagtac

SEQ ID NO: 749 - DNA, 23 bp; single-stranded, linear
  oligonucleotide primer
ctcccagaggcgtcccgcacctg

SEQ ID NO: 750 - DNA, 26 bp; single-stranded, linear
  oligonucleotide primer
tgacctgagcctgatcgtaaggtcca

SEQ ID NO: 751 - DNA, 24 bp; single-stranded, linear
  oligonucleotide primer
ctgtgggctccgtgggttgttgca

SEQ ID NO: 752 - DNA, 26 bp; single-stranded, linear
  oligonucleotide primer
agggaaccagaagccgagtaagtctc

SEQ ID NO: 753 - DNA, 26 bp; single-stranded, linear
  oligonucleotide primer
agatcaagaccctggagggcgagttc

SEQ ID NO: 754 - DNA, 24 bp; single-stranded, linear
  oligonucleotide primer
gacgtggactctgggaccgtgggt

SEQ ID NO: 755 - DNA, 28 bp; single-stranded, linear
  oligonucleotide primer
catggcagacagaatcaatctacctcga

SEQ ID NO: 756 - DNA, 28 bp; single-stranded, linear
  oligonucleotide primer
agtccaattccacagctttacgggctat

SEQ ID NO: 757 - DNA, 27 bp; single-stranded, linear
  oligonucleotide primer
atgaaacctgcctgccaccacaacaac

SEQ ID NO: 758 - DNA, 28 bp; single-stranded, linear
  oligonucleotide primer
aagaacaaggccacagatagagtccgat

SEQ ID NO: 759 - DNA, 28 bp; single-stranded, linear
  oligonucleotide primer
tttggctgggcgtgaaatgactagattg

SEQ ID NO: 760 - DNA, 28 bp; single-stranded, linear
  oligonucleotide primer
gaagtgttccaagggtcatgtaaggtct

SEQ ID NO: 761 - DNA, 26 bp; single-stranded, linear
  oligonucleotide primer
gaagaacgcggctggagcattggatt

SEQ ID NO: 762 - DNA, 26 bp; single-stranded, linear
  oligonucleotide primer
acagaatcagaagtgcttggtgcccg

SEQ ID NO: 763 - DNA, 27 bp; single-stranded, linear
  oligonucleotide primer
ccaccgcaagaaacaaactgacatcgg

SEQ ID NO: 764 - DNA, 28 bp; single-stranded, linear
  oligonucleotide primer
taaatggcgctgttgctttcagtaccac

SEQ ID NO: 765 - DNA, 25 bp; single-stranded, linear
  oligonucleotide primer
cccgaatgggtggataccgtcaagc

SEQ ID NO: 766 - DNA, 26 bp; single-stranded, linear
  oligonucleotide primer
tttgtccctgaggtgtcagtttgcgg

SEQ ID NO: 767 - DNA, 24 bp; single-stranded, linear
  oligonucleotide primer
gtcctagccacgccctgtatgacc

SEQ ID NO: 768 - DNA, 27 bp; single-stranded, linear
  oligonucleotide primer
ctcccattcactgtgtcaccacacttc

SEQ ID NO: 769 - DNA, 26 bp; single-stranded, linear
  oligonucleotide primer
gcaggcgaagttcccaccttactaca

SEQ ID NO: 770 - DNA, 26 bp; single-stranded, linear
  oligonucleotide primer
tgggcgtctgcgtcggtaattgaagt

SEQ ID NO: 771 - DNA, 28 bp; single-stranded, linear
  oligonucleotide primer
cctgaagatgtgaagccaccagtcttag

SEQ ID NO: 772 - DNA, 28 bp; single-stranded, linear
  oligonucleotide primer
gatgttagtcacagggtcatttgggctg

SEQ ID NO: 773 - DNA, 23 bp; single-stranded, linear
  oligonucleotide primer
cacttccggctcctgcgtcgctc

SEQ ID NO: 774 - DNA, 26 bp; single-stranded, linear
  oligonucleotide primer
ccaaactagctgctccagggccttgt

SEQ ID NO: 775 - DNA, 24 bp; single-stranded, linear
  oligonucleotide primer
cgacggagcccagcaagccttgag

SEQ ID NO: 776 - DNA, 24 bp; single-stranded, linear
  oligonucleotide primer
ttcagcgcctgcctcatgtctccc

SEQ ID NO: 777 - DNA, 25 bp; single-stranded, linear
  oligonucleotide primer
aaaggcgggaactgaggcgactgtg

SEQ ID NO: 778 - DNA, 26 bp; single-stranded, linear
  oligonucleotide primer
gcagctactcctcgatccttggtcag

SEQ ID NO: 779 - DNA, 26 bp; single-stranded, linear
  oligonucleotide primer
cccaccgaagttccaggtaacactga

SEQ ID NO: 780 - DNA, 26 bp; single-stranded, linear
  oligonucleotide primer
ggctttagagttgggaggtcagggaa

SEQ ID NO: 781 - DNA, 26 bp; single-stranded, linear
  oligonucleotide primer
catccttagaggctctgtgccgtatg

SEQ ID NO: 782 - DNA, 26 bp; single-stranded, linear
  oligonucleotide primer
agagtggttgctgccagggattgtct

SEQ ID NO: 783 - DNA, 26 bp; single-stranded, linear
  oligonucleotide primer
ctgtcaatggcagcaacaggaccatg

SEQ ID NO: 784 - DNA, 25 bp; single-stranded, linear
  oligonucleotide primer
ctgtaaacggtagcgagatcgcggg

SEQ ID NO: 785 - DNA, 24 bp; single-stranded, linear
  oligonucleotide primer
agttcctgctgcctgggtaggccc

SEQ ID NO: 786 - DNA, 26 bp; single-stranded, linear
  oligonucleotide primer
cacgtagcacagcatccactcgctca

SEQ ID NO: 787 - DNA, 26 bp; single-stranded, linear
  oligonucleotide primer
gatccgaccctgatgaatatgccagc

SEQ ID NO: 788 - DNA, 26 bp; single-stranded, linear
  oligonucleotide primer
aagaacctcggaagacactccatccc

SEQ ID NO: 789 - DNA, 25 bp; single-stranded, linear
  oligonucleotide primer
agacgccacactggtgacacaggag

SEQ ID NO: 790 - DNA, 28 bp; single-stranded, linear
  oligonucleotide primer
ggccgttgctctgtattcttactgatcg

SEQ ID NO: 791 - DNA, 24 bp; single-stranded, linear
  oligonucleotide primer
gactgcaaggtgcagctccgccat

SEQ ID NO: 792 - DNA, 26 bp; single-stranded, linear
  oligonucleotide primer
gggttccgcactgtgaggtagatgtg

SEQ ID NO: 793 - DNA, 24 bp; single-stranded, linear
  oligonucleotide primer
ctggcagccaagcccagttgaagg

SEQ ID NO: 794 - DNA, 24 bp; single-stranded, linear
  oligonucleotide primer
tcggtgtaggcagggtgcatctcc

SEQ ID NO: 795 - DNA, 27 bp; single-stranded, linear
  oligonucleotide primer
gggcagatgcctaatttcgcacaatgc

SEQ ID NO: 796 - DNA, 26 bp; single-stranded, linear
  oligonucleotide primer
ggctctacctggctgttctgacttga

SEQ ID NO: 797 - DNA, 24 bp; single-stranded, linear
  oligonucleotide primer
ggagagcaacgcggtgcatcacca

SEQ ID NO: 798 - DNA, 26 bp; single-stranded, linear
  oligonucleotide primer
cagggtacaggcccacgtcttgtatg

SEQ ID NO: 799 - DNA, 25 bp; single-stranded, linear
  oligonucleotide primer
tctacacggcccatgtgggctacag

SEQ ID NO: 800 - DNA, 28 bp; single-stranded, linear
  oligonucleotide primer
ggcctctagctctgttcaactgtcaatt

SEQ ID NO: 801 - DNA, 24 bp; single-stranded, linear
  oligonucleotide primer
ccgaggtcaaggcccagtatgagg

SEQ ID NO: 802 - DNA, 24 bp; single-stranded, linear
  oligonucleotide primer
gtagtcacgcagcagccgcgccaa

SEQ ID NO: 803 - DNA, 23 bp; single-stranded, linear
  oligonucleotide primer
catggagcagcatctcccgcccc

SEQ ID NO: 804 - DNA, 24 bp; single-stranded, linear
  oligonucleotide primer
catcttgcgcttcgcctcggcgtt

SEQ ID NO: 805 - DNA, 28 bp; single-stranded, linear
  oligonucleotide primer
ttgtggcttattcaacctcacaaccctg

SEQ ID NO: 806 - DNA, 29 bp; single-stranded, linear
  oligonucleotide primer
gttacagaccctagatattccctaaggga

SEQ ID NO: 807 - DNA, 24 bp; single-stranded, linear
  oligonucleotide primer
ccttccagtcggcaggcagtccac

SEQ ID NO: 808 - DNA, 23 bp; single-stranded, linear
  oligonucleotide primer
tccctcgctcttcggatgccggg

SEQ ID NO: 809 - DNA, 28 bp; single-stranded, linear
  oligonucleotide primer
tttgcactggactctgggaacctttcat

SEQ ID NO: 810 - DNA, 28 bp; single-stranded, linear
  oligonucleotide primer
ctcacattgccaccaacagacatagatc

SEQ ID NO: 811 - DNA, 28 bp; single-stranded, linear
  oligonucleotide primer
tgcagatccagctatcagcaactcatct

SEQ ID NO: 812 - DNA, 27 bp; single-stranded, linear
  oligonucleotide primer
gtggtgtcacgagaagtagaggtctct

SEQ ID NO: 813 - DNA, 24 bp; single-stranded, linear
  oligonucleotide primer
cccacacctcgggtatgaaccgcc

SEQ ID NO: 814 - DNA, 25 bp; single-stranded, linear
  oligonucleotide primer
cactaaccctcagcctgacacccag

SEQ ID NO: 815 - DNA, 24 bp; single-stranded, linear
  oligonucleotide primer
ggcatcgtcagcacccgcaacctc

SEQ ID NO: 816 - DNA, 23 bp; single-stranded, linear
  oligonucleotide primer
ccaaggccgagaaccgtctgcgc

SEQ ID NO: 817 - DNA, 24 bp; single-stranded, linear
  oligonucleotide primer
acccaggcccagcttcgggcattt

SEQ ID NO: 818 - DNA, 26 bp; single-stranded, linear
  oligonucleotide primer
ggcaacggtgaccgtggttggcaatt

SEQ ID NO: 819 - DNA, 26 bp; single-stranded, linear
  oligonucleotide primer
cagccactgtcacaggcatattccct

SEQ ID NO: 820 - DNA, 27 bp; single-stranded, linear
  oligonucleotide primer
cacaaactcagtaggagtgcaagggct

SEQ ID NO: 821 - DNA, 28 bp; single-stranded, linear
  oligonucleotide primer
gaatatactgagcacttacactcggcca

SEQ ID NO: 822 - DNA, 28 bp; single-stranded, linear
  oligonucleotide primer
ggtgtggttgttggtaagaggttatctg

SEQ ID NO: 823 - DNA, 26 bp; single-stranded, linear
  oligonucleotide primer
tacagtggagttcctgtgggaccctg

SEQ ID NO: 824 - DNA, 28 bp; single-stranded, linear
  oligonucleotide primer
ggtgtggttgttggtaagaggttatctg

SEQ ID NO: 825 - DNA, 26 bp; single-stranded, linear
  oligonucleotide primer
cccgcgacatgatggacgcctttatc

SEQ ID NO: 826 - DNA, 26 bp; single-stranded, linear
  oligonucleotide primer
ggtggcatgaggaatagtgacaggca

SEQ ID NO: 827 - DNA, 26 bp; single-stranded, linear
  oligonucleotide primer
tggaggacgacggcgagttctacatg

SEQ ID NO: 828 - DNA, 27 bp; single-stranded, linear
  oligonucleotide primer
catgcggttcctgttgatggttgtgga

SEQ ID NO: 829 - DNA, 26 bp; single-stranded, linear
  oligonucleotide primer
acaggacctccagaccgatgtcaaca

SEQ ID NO: 830 - DNA, 28 bp; single-stranded, linear
  oligonucleotide primer
agtctatctgttgtggagtgccacgaat

SEQ ID NO: 831 - DNA, 26 bp; single-stranded, linear
  oligonucleotide primer
ggcaccagtgatcgacacattcgcat

SEQ ID NO: 832 - DNA, 26 bp; single-stranded, linear
  oligonucleotide primer
gccatagcctcagggtctcatctgct

SEQ ID NO: 833 - DNA, 27 bp; single-stranded, linear
  oligonucleotide primer
atcaagccatcggagctgctagagttc

SEQ ID NO: 834 - DNA, 28 bp; single-stranded, linear
  oligonucleotide primer
tcatttgccaaagtcaagacgacgacca

SEQ ID NO: 835 - DNA, 24 bp; single-stranded, linear
  oligonucleotide primer
agggtggcacacccatccgtttgc

SEQ ID NO: 836 - DNA, 26 bp; single-stranded, linear
  oligonucleotide primer
aacaagcggcagctatgagtcaggga

SEQ ID NO: 837 - DNA, 24 bp; single-stranded, linear
  oligonucleotide primer
cggctggttcggctctacgctgtg

SEQ ID NO: 838 - DNA, 26 bp; single-stranded, linear
  oligonucleotide primer
cctcaatgaggcgtgctaggccaaag

SEQ ID NO: 839 - DNA, 26 bp; single-stranded, linear
  oligonucleotide primer
gtcatagagcctgcctccaaccatga

SEQ ID NO: 840 - DNA, 28 bp; single-stranded, linear
  oligonucleotide primer
ctctgtactgaagccagtctgattcctt

SEQ ID NO: 841 - DNA, 26 bp; single-stranded, linear
  oligonucleotide primer
gtagactcaagttcgctgacaggtcc

SEQ ID NO: 842 - DNA, 28 bp; single-stranded, linear
  oligonucleotide primer
tgaatcgcttgctgcaacaactgttcca

SEQ ID NO: 843 - DNA, 28 bp; single-stranded, linear
  oligonucleotide primer
tcagttcagtaaggtctggttcacgcta

SEQ ID NO: 844 - DNA, 27 bp; single-stranded, linear
  oligonucleotide primer
ggaattgtggtcatcccagggttgaag

SEQ ID NO: 845 - DNA, 24 bp; single-stranded, linear
  oligonucleotide primer
gcagagcacggacagctatccggt

SEQ ID NO: 846 - DNA, 25 bp; single-stranded, linear
  oligonucleotide primer
cgcgctcatgttcacggcttacggt

SEQ ID NO: 847 - DNA, 26 bp; single-stranded, linear
  oligonucleotide primer
aaagcaggccagaccatcaccgttgc

SEQ ID NO: 848 - DNA, 27 bp; single-stranded, linear
  oligonucleotide primer
ggaactgtgatccgtgtaggcaacttc

SEQ ID NO: 849 - DNA, 26 bp; single-stranded, linear
  oligonucleotide primer
acgaccctactcgcccagtcagtatg

SEQ ID NO: 850 - DNA, 25 bp; single-stranded, linear
  oligonucleotide primer
ccctgtccgtctaaatggtctggcc

SEQ ID NO: 851 - DNA, 28 bp; single-stranded, linear
  oligonucleotide primer
ttgctgaagtcagttcgcaattcagacc

SEQ ID NO: 852 - DNA, 27 bp; single-stranded, linear
  oligonucleotide primer
cagatcgctgccattctgttgcttctg

SEQ ID NO: 853 - DNA, 28 bp; single-stranded, linear
  oligonucleotide primer
attagcagcggaacaaggagtcagacat

SEQ ID NO: 854 - DNA, 28 bp; single-stranded, linear
  oligonucleotide primer
ctgtgaaagacacagaacagtacagggt

SEQ ID NO: 855 - DNA, 26 bp; single-stranded, linear
  oligonucleotide primer
ggccttatgagggtcctctacttcag

SEQ ID NO: 856 - DNA, 25 bp; single-stranded, linear
  oligonucleotide primer
cactgtgagccgagatcgctaccac

SEQ ID NO: 857 - DNA, 27 bp; single-stranded, linear
  oligonucleotide primer
gtctgctatacagctcagactctcgtc

SEQ ID NO: 858 - DNA, 28 bp; single-stranded, linear
  oligonucleotide primer
gggagactggcagctaagccaatatcaa

SEQ ID NO: 859 - DNA, 25 bp; single-stranded, linear
  oligonucleotide primer
accagtcctcacaaggcggctatgg

SEQ ID NO: 860 - DNA, 26 bp; single-stranded, linear
  oligonucleotide primer
ggctaaatatgggtcacaggacgggc

SEQ ID NO: 861 - DNA, 23 bp; single-stranded, linear
  oligonucleotide primer
caacagttgcggcggcgacgacc

SEQ ID NO: 862 - DNA, 28 bp; single-stranded, linear
  oligonucleotide primer
tatgagtggtgaatgtattgaggcgagc

SEQ ID NO: 863 - DNA, 26 bp; single-stranded, linear
  oligonucleotide primer
tccacagactgaccattggtcggagt

SEQ ID NO: 864 - DNA, 28 bp; single-stranded, linear
  oligonucleotide primer
cctgaatcactagcggcagcactgattt

SEQ ID NO: 865 - DNA, 28 bp; single-stranded, linear
  oligonucleotide primer
tttcagctctttgacaacgccaactgcc

SEQ ID NO: 866 - DNA, 28 bp; single-stranded, linear
  oligonucleotide primer
cttcccgatccttgataagtgcgttcac

SEQ ID NO: 867 - DNA, 24 bp; single-stranded, linear
  oligonucleotide primer
agtcacggactcctgcatcgtggc

SEQ ID NO: 868 - DNA, 24 bp; single-stranded, linear
  oligonucleotide primer
tgttccgcatggcggcagtccctt

SEQ ID NO: 869 - DNA, 28 bp; single-stranded, linear
  oligonucleotide primer
gcgatagtgaaagtagttaccgtggtca

SEQ ID NO: 870 - DNA, 28 bp; single-stranded, linear
  oligonucleotide primer
ccagacacatcaaggatacagtgtttgc

SEQ ID NO: 871 - DNA, 26 bp; single-stranded, linear
  oligonucleotide primer
accattgaccaccagtcttgctctcg

SEQ ID NO: 872 - DNA, 28 bp; single-stranded, linear
  oligonucleotide primer
caccatgttcctgaatcgaccaactgag

SEQ ID NO: 873 - DNA, 26 bp; single-stranded, linear
  oligonucleotide primer
catgtggcaccgtttgcctcaagtac

SEQ ID NO: 874 - DNA, 26 bp; single-stranded, linear
  oligonucleotide primer
gtaggcgaggataccagcgatgatct

SEQ ID NO: 875 - DNA, 25 bp; single-stranded, linear
  oligonucleotide primer
tcttgaacgtgctggacagggcctg

SEQ ID NO: 876 - DNA, 26 bp; single-stranded, linear
  oligonucleotide primer
tcgtcgatgatgtagagttcctcgcc

SEQ ID NO: 877 - DNA, 24 bp; single-stranded, linear
  oligonucleotide primer
gcttcaccatcctgggcgtgctca

SEQ ID NO: 878 - DNA, 28 bp; single-stranded, linear
  oligonucleotide primer
caccacaaagattaggacagaccgcgta

SEQ ID NO: 879 - DNA, 26 bp; single-stranded, linear
  oligonucleotide primer
cttctcaatgagcccgacggaacctt

SEQ ID NO: 880 - DNA, 26 bp; single-stranded, linear
  oligonucleotide primer
tccacggtcatcttgatggtagctgg

SEQ ID NO: 881 - DNA, 26 bp; single-stranded, linear
  oligonucleotide primer
catggctggccgcatctacatctcag

SEQ ID NO: 882 - DNA, 24 bp; single-stranded, linear
  oligonucleotide primer
gagcgatggagcgtgggtagggag

SEQ ID NO: 883 - DNA, 23 bp; single-stranded, linear
  oligonucleotide primer
ctgtgggcctggccgtctttgcc

SEQ ID NO: 884 - DNA, 23 bp; single-stranded, linear
  oligonucleotide primer
ccgagcactctcggacgcctcct

SEQ ID NO: 885 - DNA, 25 bp; single-stranded, linear
  oligonucleotide primer
tgcaacgtggttgggacttgacccc

SEQ ID NO: 886 - DNA, 26 bp; single-stranded, linear
  oligonucleotide primer
tgacgagttcgattgcgacaggttgg

SEQ ID NO: 887 - DNA, 28 bp; single-stranded, linear
  oligonucleotide primer
ccctctattatcaaacaaatgcgccacc

SEQ ID NO: 888 - DNA, 28 bp; single-stranded, linear
  oligonucleotide primer
gatgatagactccaagatggacgacagc

SEQ ID NO: 889 - DNA, 26 bp; single-stranded, linear
  oligonucleotide primer
acacagcacaacgtcttaccgtgcct

SEQ ID NO: 890 - DNA, 26 bp; single-stranded, linear
  oligonucleotide primer
gttgcgggtcttcagatggcgtcatg

SEQ ID NO: 891 - DNA, 27 bp; single-stranded, linear
  oligonucleotide primer
aattggccttgttgctgccgcttcatc

SEQ ID NO: 892 - DNA, 26 bp; single-stranded, linear
  oligonucleotide primer
gcctatcggcctcagcatggtccaat

SEQ ID NO: 893 - DNA, 24 bp; single-stranded, linear
  oligonucleotide primer
cacagccatcccagcaaccttggg

SEQ ID NO: 894 - DNA, 28 bp; single-stranded, linear
  oligonucleotide primer
gggcaaactccttatgaagtggcacaaa

SEQ ID NO: 895 - DNA, 26 bp; single-stranded, linear
  oligonucleotide primer
ccggtgcttctggaaactaccaggtg

SEQ ID NO: 896 - DNA, 28 bp; single-stranded, linear
  oligonucleotide primer
ggctgacctcgggaatgttagacaagat

SEQ ID NO: 897 - DNA, 26 bp; single-stranded, linear
  oligonucleotide primer
ccctcattaagcccaagcgaaggctg

SEQ ID NO: 898 - DNA, 26 bp; single-stranded, linear
  oligonucleotide primer
gccgggttaaacgagctgttcttggg

SEQ ID NO: 899 - DNA, 28 bp; single-stranded, linear
  oligonucleotide primer
cagactcagaattgtccactgtaccttc

SEQ ID NO: 900 - DNA, 27 bp; single-stranded, linear
  oligonucleotide primer
gggctgatgatggtccttaggtttcag

SEQ ID NO: 901 - DNA, 28 bp; single-stranded, linear
  oligonucleotide primer
ccctgatggacatcctttgactgtctat

SEQ ID NO: 902 - DNA, 28 bp; single-stranded, linear
  oligonucleotide primer
gtggcgattcaataacccttgttcagct

SEQ ID NO: 903 - DNA, 27 bp; single-stranded, linear
  oligonucleotide primer
catcctgtccagcaatgaagtagaccc

SEQ ID NO: 904 - DNA, 28 bp; single-stranded, linear
  oligonucleotide primer
caaggtactttggcccagtcaatcaaag

SEQ ID NO: 905 - DNA, 27 bp; single-stranded, linear
  oligonucleotide primer
ggccttccagttcactgacaaacatgg

SEQ ID NO: 906 - DNA, 26 bp; single-stranded, linear
  oligonucleotide primer
acgccaactcaggccattcctaccaa

SEQ ID NO: 907 - DNA, 28 bp; single-stranded, linear
  oligonucleotide primer
aaactgtgctgtccttgtgaggtcactg

SEQ ID NO: 908 - DNA, 28 bp; single-stranded, linear
  oligonucleotide primer
cactcaaggtttgggagtataagcaccc

SEQ ID NO: 909 - DNA, 24 bp; single-stranded, linear
  oligonucleotide primer
ggcccaccatcagctacccaatgc

SEQ ID NO: 910 - DNA, 25 bp; single-stranded, linear
  oligonucleotide primer
cgtcactcgcagtcgtgaacttccc

SEQ ID NO: 911 - DNA, 28 bp; single-stranded, linear
  oligonucleotide primer
cctgtggaaagtgcgaagatagaaccac

SEQ ID NO: 912 - DNA, 28 bp; single-stranded, linear
  oligonucleotide primer
catagtgttccagatcacttgttgccgc

SEQ ID NO: 913 - DNA, 28 bp; single-stranded, linear
  oligonucleotide primer
aacttcctatgtcacagggtccactatg

SEQ ID NO: 914 - DNA, 28 bp; single-stranded, linear
  oligonucleotide primer
ctgtcctactgctatattaggcatggcc

SEQ ID NO: 915 - DNA, 25 bp; single-stranded, linear
  oligonucleotide primer
ggcacccaggccaggaagtttgatg

SEQ ID NO: 916 - DNA, 26 bp; single-stranded, linear
  oligonucleotide primer
atctacatagccattgagccgggcag

SEQ ID NO: 917 - DNA, 25 bp; single-stranded, linear
  oligonucleotide primer
cgcgcagattgccatttgcggcatg

SEQ ID NO: 918 - DNA, 28 bp; single-stranded, linear
  oligonucleotide primer
gtctgcggcttcactttgtctattgcga

SEQ ID NO: 919 - DNA, 26 bp; single-stranded, linear
  oligonucleotide primer
ggtggtgagttcttgctgcggtatgc

SEQ ID NO: 920 - DNA, 25 bp; single-stranded, linear
  oligonucleotide primer
cagtagcatcatgggcaccgccatg

SEQ ID NO: 921 - DNA, 26 bp; single-stranded, linear
  oligonucleotide primer
acacaatggcaagcatagtcgcctgg

SEQ ID NO: 922 - DNA, 26 bp; single-stranded, linear
  oligonucleotide primer
caccctccgttacgctgtttcacacg

SEQ ID NO: 923 - DNA, 26 bp; single-stranded, linear
  oligonucleotide primer
agggcacattcaccagtgactacagc

SEQ ID NO: 924 - DNA, 28 bp; single-stranded, linear
  oligonucleotide primer
taaagtccctggcggcaagattatcaag

SEQ ID NO: 925 - DNA, 28 bp; single-stranded, linear
  oligonucleotide primer
gggcggttagagatggatcaacaatgac

SEQ ID NO: 926 - DNA, 28 bp; single-stranded, linear
  oligonucleotide primer
ccaataggtgttcccactccgtaacctt

SEQ ID NO: 927 - DNA, 23 bp; single-stranded, linear
  oligonucleotide primer
gagagcccgacgctcaactcccc

SEQ ID NO: 928 - DNA, 24 bp; single-stranded, linear
  oligonucleotide primer
tccatccgaggtggtgcggacatg

SEQ ID NO: 929 - DNA, 26 bp; single-stranded, linear
  oligonucleotide primer
cactgggacagaggctgagtttgaga

SEQ ID NO: 930 - DNA, 26 bp; single-stranded, linear
  oligonucleotide primer
cagctcattccaggcatcccacttgg

SEQ ID NO: 931 - DNA, 26 bp; single-stranded, linear
  oligonucleotide primer
aggcatcatcatgggcactttcaccc

SEQ ID NO: 932 - DNA, 28 bp; single-stranded, linear
  oligonucleotide primer
tgttatcgctaggcacagtaccttgatg

SEQ ID NO: 933 - DNA, 26 bp; single-stranded, linear
  oligonucleotide primer
actgtgactgcaacatcccgcctgtc

SEQ ID NO: 934 - DNA, 25 bp; single-stranded, linear
  oligonucleotide primer
ggagcatggagccaagcgaacactg

SEQ ID NO: 935 - DNA, 24 bp; single-stranded, linear
  oligonucleotide primer
cgtcaacgctagtgccgtcagccg

SEQ ID NO: 936 - DNA, 27 bp; single-stranded, linear
  oligonucleotide primer
gaccatattctgtctcccgcttggact

SEQ ID NO: 937 - DNA, 24 bp; single-stranded, linear
  oligonucleotide primer
gtgcgtcatcagcgtggaccgcta

SEQ ID NO: 938 - DNA, 27 bp; single-stranded, linear
  oligonucleotide primer
gggatgtagaagctgatgagcgaggaa

SEQ ID NO: 939 - DNA, 24 bp; single-stranded, linear
  oligonucleotide primer
tgcaccagggtctacgtccgagag

SEQ ID NO: 940 - DNA, 26 bp; single-stranded, linear
  oligonucleotide primer
ggtagaagctagagggccagtctttc

SEQ ID NO: 941 - DNA, 25 bp; single-stranded, linear
  oligonucleotide primer
ggcctacgaattggccgactacagc

SEQ ID NO: 942 - DNA, 28 bp; single-stranded, linear
  oligonucleotide primer
gggcagtgtttctcaaatagggattggg

SEQ ID NO: 943 - DNA, 24 bp; single-stranded, linear
  oligonucleotide primer
atggcctcaccagcaagcgggagc

SEQ ID NO: 944 - DNA, 27 bp; single-stranded, linear
  oligonucleotide primer
gctgactccgcataaattggccgaaga

SEQ ID NO: 945 - DNA, 26 bp; single-stranded, linear
  oligonucleotide primer
catgcaaggtgctgggcatcgtcttc

SEQ ID NO: 946 - DNA, 28 bp; single-stranded, linear
  oligonucleotide primer
gacttgtaggccaaagccggtattgtgt

SEQ ID NO: 947 - DNA, 26 bp; single-stranded, linear
  oligonucleotide primer
acatctggctgtcctctgacatcacg

SEQ ID NO: 948 - DNA, 27 bp; single-stranded, linear
  oligonucleotide primer
catagagtgagggtggattcaggatgc

SEQ ID NO: 949 - DNA, 26 bp; single-stranded, linear
  oligonucleotide primer
ccatttactccacgctgggtgcgttt

SEQ ID NO: 950 - DNA, 26 bp; single-stranded, linear
  oligonucleotide primer
ccttccgttccctggtgctagagatc

SEQ ID NO: 951 - DNA, 28 bp; single-stranded, linear
  oligonucleotide primer
ctgctacagtcgccaaatcaccagtatt

SEQ ID NO: 952 - DNA, 25 bp; single-stranded, linear
  oligonucleotide primer
ctccgtggagcttcccaaacctctc

SEQ ID NO: 953 - DNA, 23 bp; single-stranded, linear
  oligonucleotide primer
gcagacggagtggcccgagtgcg

SEQ ID NO: 954 - DNA, 28 bp; single-stranded, linear
  oligonucleotide primer
gtttggactctgcccgtgatttgtaaca

SEQ ID NO: 955 - DNA, 24 bp; single-stranded, linear
  oligonucleotide primer
cccggcccagatgaaagttggctg

SEQ ID NO: 956 - DNA, 26 bp; single-stranded, linear
  oligonucleotide primer
gcgctcaaggctgggaaatactgact

SEQ ID NO: 957 - DNA, 26 bp; single-stranded, linear
  oligonucleotide primer
cttacggaggctggtccttggatctg

SEQ ID NO: 958 - DNA, 25 bp; single-stranded, linear
  oligonucleotide primer
cggatgttgcgggcatgatctcagc

SEQ ID NO: 959 - DNA, 26 bp; single-stranded, linear
  oligonucleotide primer
catggccttatgaggcaggtgagaga

SEQ ID NO: 960 - DNA, 26 bp; single-stranded, linear
  oligonucleotide primer
agcactcaaggacaagggtgacagag

SEQ ID NO: 961 - DNA, 24 bp; single-stranded, linear
  oligonucleotide primer
gggaggccacatcaagggtgcagt

SEQ ID NO: 962 - DNA, 24 bp; single-stranded, linear
  oligonucleotide primer
ggtccggctcttggtgcggaactt

SEQ ID NO: 963 - DNA, 25 bp; single-stranded, linear
  oligonucleotide primer
gtgcatctacaccgaccacgctgtc

SEQ ID NO: 964 - DNA, 24 bp; single-stranded, linear
  oligonucleotide primer
caggcccgcaggcagtccacttca

SEQ ID NO: 965 - DNA, 23 bp; single-stranded, linear
  oligonucleotide primer
gcgcatccgccagacggtcaacc

SEQ ID NO: 966 - DNA, 24 bp; single-stranded, linear
  oligonucleotide primer
ggcccacaccttgtagggcacggt

SEQ ID NO: 967 - DNA, 26 bp; single-stranded, linear
  oligonucleotide primer
ggcactgctgctatgctgttagcctc

SEQ ID NO: 968 - DNA, 28 bp; single-stranded, linear
  oligonucleotide primer
ttgtcccgtgactgtgtagagtgctaaa

SEQ ID NO: 969 - DNA, 26 bp; single-stranded, linear
  oligonucleotide primer
ctaggatcacagtggcttggtgcaag

SEQ ID NO: 970 - DNA, 26 bp; single-stranded, linear
  oligonucleotide primer
gctgacaaattcccatccacttgccc

SEQ ID NO: 971 - DNA, 28 bp; single-stranded, linear
  oligonucleotide primer
caatgctcagctctttggctcgattgtt

SEQ ID NO: 972 - DNA, 28 bp; single-stranded, linear
  oligonucleotide primer
ttctcggtgccattcaacatgggttcta

SEQ ID NO: 973 - DNA, 23 bp; single-stranded, linear
  oligonucleotide primer
cccgctgcggttctcggaggtcc

SEQ ID NO: 974 - DNA, 25 bp; single-stranded, linear
  oligonucleotide primer
cagaccactctgtggcacgggatga

SEQ ID NO: 975 - DNA, 24 bp; single-stranded, linear
  oligonucleotide primer
tcaccatgacgctggcacgggtct

SEQ ID NO: 976 - DNA, 24 bp; single-stranded, linear
  oligonucleotide primer
agggcgacactggtttcggcacca

SEQ ID NO: 977 - DNA, 26 bp; single-stranded, linear
  oligonucleotide primer
gattccgtggagtgcaggacattgtg

SEQ ID NO: 978 - DNA, 26 bp; single-stranded, linear
  oligonucleotide primer
tcaaagcgagccaccactgacttgag

SEQ ID NO: 979 - DNA, 28 bp; single-stranded, linear
  oligonucleotide primer
cagtttccagtcggatgtctactcctat

SEQ ID NO: 980 - DNA, 26 bp; single-stranded, linear
  oligonucleotide primer
gcgctccggttgatcttcggtagaga

SEQ ID NO: 981 - DNA, 26 bp; single-stranded, linear
  oligonucleotide primer
gatcctgtcagccctgggttctaaga

SEQ ID NO: 982 - DNA, 28 bp; single-stranded, linear
  oligonucleotide primer
cgtctacgatgatatgacccttgtcatc

SEQ ID NO: 983 - DNA, 23 bp; single-stranded, linear
  oligonucleotide primer
ggtcctggacagcaccgaggcgc

SEQ ID NO: 984 - DNA, 24 bp; single-stranded, linear
  oligonucleotide primer
catgggtatgggcgagcccgcatg

SEQ ID NO: 985 - DNA, 26 bp; single-stranded, linear
  oligonucleotide primer
gcctgtgatgctgggcacttcatctg

SEQ ID NO: 986 - DNA, 26 bp; single-stranded, linear
  oligonucleotide primer
tttggttcggcagcttgctaggtgac

SEQ ID NO: 987 - DNA, 28 bp; single-stranded, linear
  oligonucleotide primer
aaatggttgacctcacccaggtaatgga

SEQ ID NO: 988 - DNA, 28 bp; single-stranded, linear
  oligonucleotide primer
agatccgtgctccgacaaatagtctgaa

SEQ ID NO: 989 - DNA, 25 bp; single-stranded, linear
  oligonucleotide primer
gaagaacttcgccttgcgggtcctg

SEQ ID NO: 990 - DNA, 28 bp; single-stranded, linear
  oligonucleotide primer
ggcgatgagctgttccagagatccaaat

SEQ ID NO: 991 - DNA, 28 bp; single-stranded, linear
  oligonucleotide primer
ctatgatgtccttgacctccaccgtata

SEQ ID NO: 992 - DNA, 28 bp; single-stranded, linear
  oligonucleotide primer
atgttcacgaaggatagtgggtagctga

SEQ ID NO: 993 - DNA, 24 bp; single-stranded, linear
  oligonucleotide primer
cggagacctcaccctgtaccagtc

SEQ ID NO: 994 - DNA, 26 bp; single-stranded, linear
  oligonucleotide primer
gcagcaagtccagcaggttgtagtca

SEQ ID NO: 995 - DNA, 26 bp; single-stranded, linear
  oligonucleotide primer
agctggtgcagaccagagccattctc

SEQ ID NO: 996 - DNA, 26 bp; single-stranded, linear
  oligonucleotide primer
ggagtcaagctcctcgacgtagtaga

SEQ ID NO: 997 - DNA, 28 bp; single-stranded, linear
  oligonucleotide primer
tcaggactttgtgagttagcatgaccct

SEQ ID NO: 998 - DNA, 28 bp; single-stranded, linear
  oligonucleotide primer
tacagactgtaaatagagtcgggtaggc

SEQ ID NO: 999 - DNA, 26 bp; single-stranded, linear
  oligonucleotide primer
aaaccctgaagcctggcacgatgtct

SEQ ID NO: 1000 - DNA, 25 bp; single-stranded, linear
  oligonucleotide primer
caggatgttggctgcacgaaggtcc

SEQ ID NO: 1001 - DNA, 28 bp; single-stranded, linear
  oligonucleotide primer
tctcaagtggattgtcacatcatgcctc

SEQ ID NO: 1002 - DNA, 28 bp; single-stranded, linear
  oligonucleotide primer
ggatgacgcttccattccgactatgtca

SEQ ID NO: 1003 - DNA, 27 bp; single-stranded, linear
  oligonucleotide primer
gaggtggatggaaagcaggtagagttg

SEQ ID NO: 1004 - DNA, 26 bp; single-stranded, linear
  oligonucleotide primer
tttcaccggctcctgcttcatcttgg

SEQ ID NO: 1005 - DNA, 23 bp; single-stranded, linear
  oligonucleotide primer
ccctctgaggcaccacggtccgg

SEQ ID NO: 1006 - DNA, 23 bp; single-stranded, linear
  oligonucleotide primer
taagcgcggtggcgtcgtcgctg

SEQ ID NO: 1007 - DNA, 26 bp; single-stranded, linear
  oligonucleotide primer
gtgctggctacatggagccctatgag

SEQ ID NO: 1008 - DNA, 28 bp; single-stranded, linear
  oligonucleotide primer
gactgccgcttctcgttgccattaaact

SEQ ID NO: 1009 - DNA, 26 bp; single-stranded, linear
  oligonucleotide primer
caggcgacgagtttgaactgcggtac

SEQ ID NO: 1010 - DNA, 28 bp; single-stranded, linear
  oligonucleotide primer
aaggctctaggtggtcattcaggtaagt

SEQ ID NO: 1011 - DNA, 28 bp; single-stranded, linear
  oligonucleotide primer
agtgcagggcatcatcaatttcgagcag

SEQ ID NO: 1012 - DNA, 28 bp; single-stranded, linear
  oligonucleotide primer
gatgcaatggtctcctgagagtgagatc

SEQ ID NO: 1013 - DNA, 24 bp; single-stranded, linear
  oligonucleotide primer
ggttatcggagccagcaccgctct

SEQ ID NO: 1014 - DNA, 28 bp; single-stranded, linear
  oligonucleotide primer
gtcgaagaatgaagataggcagtccctc

SEQ ID NO: 1015 - DNA, 26 bp; single-stranded, linear
  oligonucleotide primer
cctccacaactacaatgccgtactgg

SEQ ID NO: 1016 - DNA, 26 bp; single-stranded, linear
  oligonucleotide primer
aagttgaccaggccgtcttccgtgta

SEQ ID NO: 1017 - DNA, 25 bp; single-stranded, linear
  oligonucleotide primer
ccatcccggtgccaacgctagaaag

SEQ ID NO: 1018 - DNA, 26 bp; single-stranded, linear
  oligonucleotide primer
attagcaaagctgcggagtgggtgag

SEQ ID NO: 1019 - DNA, 25 bp; single-stranded, linear
  oligonucleotide primer
ccggctgaagagctacgagaaccag

SEQ ID NO: 1020 - DNA, 26 bp; single-stranded, linear
  oligonucleotide primer
ggaatgggtgcttcttgttggactcc

SEQ ID NO: 1021 - DNA, 25 bp; single-stranded, linear
  oligonucleotide primer
agtcagctcctgccagcactacagc

SEQ ID NO: 1022 - DNA, 26 bp; single-stranded, linear
  oligonucleotide primer
cgtaagactgacccgtcacaagtgca

SEQ ID NO: 1023 - DNA, 24 bp; single-stranded, linear
  oligonucleotide primer
cccacctcaggcatgtcccatccc

SEQ ID NO: 1024 - DNA, 24 bp; single-stranded, linear
  oligonucleotide primer
gcagatactccacggctcggtggg

SEQ ID NO: 1025 - DNA, 28 bp; single-stranded, linear
  oligonucleotide primer
tagtgcctccagggctggaattactatg

SEQ ID NO: 1026 - DNA, 28 bp; single-stranded, linear
  oligonucleotide primer
gattctaccaggtcgtcatcagtccatt

SEQ ID NO: 1027 - DNA, 26 bp; single-stranded, linear
  oligonucleotide primer
tcttccaggaggcccatgaggtcatt

SEQ ID NO: 1028 - DNA, 26 bp; single-stranded, linear
  oligonucleotide primer
tctcattgtggctttcaggcggctgt

SEQ ID NO: 1029 - DNA, 26 bp; single-stranded, linear
  oligonucleotide primer
cataacacgggtgaggaacgccacag

SEQ ID NO: 1030 - DNA, 25 bp; single-stranded, linear
  oligonucleotide primer
gacccagtctggctcaaagccgaca

SEQ ID NO: 1031 - DNA, 28 bp; single-stranded, linear
  oligonucleotide primer
acactggcaaggatgcagtgaattgtac

SEQ ID NO: 1032 - DNA, 27 bp; single-stranded, linear
  oligonucleotide primer
cgtgatattggtgaaggtagacgtggc

SEQ ID NO: 1033 - DNA, 24 bp; single-stranded, linear
  oligonucleotide primer
tgttcttggtgcccgtccggctga

SEQ ID NO: 1034 - DNA, 26 bp; single-stranded, linear
  oligonucleotide primer
ctcacgatcaggaggtggttatgcga

SEQ ID NO: 1035 - DNA, 24 bp; single-stranded, linear
  oligonucleotide primer
cttgtcaccatccacgaccggagg

SEQ ID NO: 1036 - DNA, 24 bp; single-stranded, linear
  oligonucleotide primer
atcaagccgagcagccgtgcaagg

SEQ ID NO: 1037 - DNA, 28 bp; single-stranded, linear
  oligonucleotide primer
cacagcagagtgactgtagcaatacctt

SEQ ID NO: 1038 - DNA, 28 bp; single-stranded, linear
  oligonucleotide primer
ctggactatgcctttcaaggtctgcatt

SEQ ID NO: 1039 - DNA, 28 bp; single-stranded, linear
  oligonucleotide primer
ctttccaaacaggacagcagacatcact

SEQ ID NO: 1040 - DNA, 28 bp; single-stranded, linear
  oligonucleotide primer
gacctcgtaatttggttgggacgcaaat

SEQ ID NO: 1041 - DNA, 26 bp; single-stranded, linear
  oligonucleotide primer
caaatctcctgtgcagtgggacgact

SEQ ID NO: 1042 - DNA, 25 bp; single-stranded, linear
  oligonucleotide primer
ctgttccctgtcggtcatgtcctcc

SEQ ID NO: 1043 - DNA, 28 bp; single-stranded, linear
  oligonucleotide primer
gtttgctgagagttaggagcacttggtg

SEQ ID NO: 1044 - DNA, 28 bp; single-stranded, linear
  oligonucleotide primer
cagactgatgtcctgacttgcacaggaa

SEQ ID NO: 1045 - DNA, 28 bp; single-stranded, linear
  oligonucleotide primer
gaccattgtccagaagacatctcatggc

SEQ ID NO: 1046 - DNA, 28 bp; single-stranded, linear
  oligonucleotide primer
taccaagagcacgtctgtaatggtgtct

SEQ ID NO: 1047 - DNA, 23 bp; single-stranded, linear
  oligonucleotide primer
aggagacgggcggcgtgttcctg

SEQ ID NO: 1048 - DNA, 26 bp; single-stranded, linear
  oligonucleotide primer
gaagcccgcttcacagtaacgcttgt

SEQ ID NO: 1049 - DNA, 26 bp; single-stranded, linear
  oligonucleotide primer
tccaaatgtcaccacgggaacggctc

SEQ ID NO: 1050 - DNA, 24 bp; single-stranded, linear
  oligonucleotide primer
acagtcgccgttacctccgcagag

SEQ ID NO: 1051 - DNA, 26 bp; single-stranded, linear
  oligonucleotide primer
tgctgtatcccacggagatcaccgtc

SEQ ID NO: 1052 - DNA, 26 bp; single-stranded, linear
  oligonucleotide primer
aatagggtagcccagccatttacccg

SEQ ID NO: 1053 - DNA, 26 bp; single-stranded, linear
  oligonucleotide primer
cttcttggtggaggatgacgccagag

SEQ ID NO: 1054 - DNA, 26 bp; single-stranded, linear
  oligonucleotide primer
agcgaggattgatggtggtcgtgatg

SEQ ID NO: 1055 - DNA, 27 bp; single-stranded, linear
  oligonucleotide primer
gtgcccaatgacggaaactgtcatctg

SEQ ID NO: 1056 - DNA, 28 bp; single-stranded, linear
  oligonucleotide primer
cattgctcgtcacgtttctgcatccttc

SEQ ID NO: 1057 - DNA, 27 bp; single-stranded, linear
  oligonucleotide primer
cctcctgttcacagccttagcaacttc

SEQ ID NO: 1058 - DNA, 26 bp; single-stranded, linear
  oligonucleotide primer
cactggtagaggccacccgtttggtt

SEQ ID NO: 1059 - DNA, 23 bp; single-stranded, linear
  oligonucleotide primer
gctgagcttcgggtcaccgcccc

SEQ ID NO: 1060 - DNA, 26 bp; single-stranded, linear
  oligonucleotide primer
ggaaaccacgtcgctttgcgagttgt

SEQ ID NO: 1061 - DNA, 28 bp; single-stranded, linear
  oligonucleotide primer
caaggtagaaagtcgggacaaattaccc

SEQ ID NO: 1062 - DNA, 28 bp; single-stranded, linear
  oligonucleotide primer
ggattgaccacagttgttacggcactct

SEQ ID NO: 1063 - DNA, 28 bp; single-stranded, linear
  oligonucleotide primer
cctgaggactgatttcagagtgactaca

SEQ ID NO: 1064 - DNA, 28 bp; single-stranded, linear
  oligonucleotide primer
tcttgtgatgtgggacagctaacgtgat

SEQ ID NO: 1065 - DNA, 23 bp; single-stranded, linear
  oligonucleotide primer
ttcgggccagagcgcgagggcat

SEQ ID NO: 1066 - DNA, 23 bp; single-stranded, linear
  oligonucleotide primer
gacgcctagtgggacatggcggg

SEQ ID NO: 1067 - DNA, 28 bp; single-stranded, linear
  oligonucleotide primer
acagcgaagaacctcctgaaaccctttc

SEQ ID NO: 1068 - DNA, 28 bp; single-stranded, linear
  oligonucleotide primer
gttgggtacagcacagggtaaccatttg

SEQ ID NO: 1069 - DNA, 24 bp; single-stranded, linear
  oligonucleotide primer
gctgtggctgccctccatcccttc

SEQ ID NO: 1070 - DNA, 25 bp; single-stranded, linear
  oligonucleotide primer
ccctctaggttaaggcacttccggg

SEQ ID NO: 1071 - DNA, 25 bp; single-stranded, linear
  oligonucleotide primer
gtcagggcgtgggacatctagtagg

SEQ ID NO: 1072 - DNA, 26 bp; single-stranded, linear
  oligonucleotide primer
tggagtgcaatggcgcaatcttggct

SEQ ID NO: 1073 - DNA, 26 bp; single-stranded, linear
  oligonucleotide primer
gagctggcagaactccgagagtctac

SEQ ID NO: 1074 - DNA, 28 bp; single-stranded, linear
  oligonucleotide primer
cttagagttcctcatgtagaccttgtgg

SEQ ID NO: 1075 - DNA, 28 bp; single-stranded, linear
  oligonucleotide primer
tgtctttgggcttctggctggtagataa

SEQ ID NO: 1076 - DNA, 28 bp; single-stranded, linear
  oligonucleotide primer
gtgtgacccacaaagtgaggacattcag

SEQ ID NO: 1077 - DNA, 24 bp; single-stranded, linear
  oligonucleotide primer
ccaggtgtagctctgagtgtgggc

SEQ ID NO: 1078 - DNA, 25 bp; single-stranded, linear
  oligonucleotide primer
gatgatacagatgggtgccgggacc

SEQ ID NO: 1079 - DNA, 25 bp; single-stranded, linear
  oligonucleotide primer
caccctggagcactctgattgtgcc

SEQ ID NO: 1080 - DNA, 28 bp; single-stranded, linear
  oligonucleotide primer
gcattgacatctttgggaaccacgtcac

SEQ ID NO: 1081 - DNA, 30 bp; single-stranded, linear
  oligonucleotide primer
acgatgagaataatgctgaagctagtgctg

SEQ ID NO: 1082 - DNA, 28 bp; single-stranded, linear
  oligonucleotide primer
ctttgtattgccttgtcgaatctgtcgc

SEQ ID NO: 1083 - DNA, 28 bp; single-stranded, linear
  oligonucleotide primer
agtctacttcactaatgacgatgccgtg

SEQ ID NO: 1084 - DNA, 28 bp; single-stranded, linear
  oligonucleotide primer
gattacttgtctgcggctgagtgagatc

SEQ ID NO: 1085 - DNA, 27 bp; single-stranded, linear
  oligonucleotide primer
gtagatgaagctctccaacacccgtac

SEQ ID NO: 1086 - DNA, 28 bp; single-stranded, linear
  oligonucleotide primer
gtctgtatcagaggccaaagtcggatct

SEQ ID NO: 1087 - DNA, 24 bp; single-stranded, linear
  oligonucleotide primer
gcggaaggtccctcagacatcccc

SEQ ID NO: 1088 - DNA, 28 bp; single-stranded, linear
  oligonucleotide primer
ctcgcaagaaatgcccacatgaatgtgc

SEQ ID NO: 1089 - DNA, 26 bp; single-stranded, linear
  oligonucleotide primer
tgcataatggccgagctgttgactgg

SEQ ID NO: 1090 - DNA, 26 bp; single-stranded, linear
  oligonucleotide primer
aagggcttgggccgctgtaattctct

SEQ ID NO: 1091 - DNA, 25 bp; single-stranded, linear
  oligonucleotide primer
gcacagcaagctgtcggtgatccac

SEQ ID NO: 1092 - DNA, 27 bp; single-stranded, linear
  oligonucleotide primer
caggcactgagcagtgaagtccacaaa

SEQ ID NO: 1093 - DNA, 27 bp; single-stranded, linear
  oligonucleotide primer
agcactgtgagtggttcaagcacactg

SEQ ID NO: 1094 - DNA, 28 bp; single-stranded, linear
  oligonucleotide primer
ctgtggtcgaaggcagacatagagcaat

SEQ ID NO: 1095 - DNA, 27 bp; single-stranded, linear
  oligonucleotide primer
ttcccatccaccagcagcacaactatg

SEQ ID NO: 1096 - DNA, 28 bp; single-stranded, linear
  oligonucleotide primer
gtctagcaagtccgagcgtgttcaattt

SEQ ID NO: 1097 - DNA, 28 bp; single-stranded, linear
  oligonucleotide primer
ctggcagaaatgacttctactcgaacac

SEQ ID NO: 1098 - DNA, 28 bp; single-stranded, linear
  oligonucleotide primer
tttcaagtggcttaggactcacccaaac

SEQ ID NO: 1099 - DNA, 28 bp; single-stranded, linear
  oligonucleotide primer
tggttgatatggctgctcagattgctga

SEQ ID NO: 1100 - DNA, 28 bp; single-stranded, linear
  oligonucleotide primer
tgtatcctcgctccacttgttctagtac

SEQ ID NO: 1101 - DNA, 25 bp; single-stranded, linear
  oligonucleotide primer
cgggacctgcgagcagctaatgttc

SEQ ID NO: 1102 - DNA, 25 bp; single-stranded, linear
  oligonucleotide primer
cagggcggtcatcacgtcggcatta

SEQ ID NO: 1103 - DNA, 27 bp; single-stranded, linear
  oligonucleotide primer
tcctcatctcaatccttgagcggcaag

SEQ ID NO: 1104 - DNA, 28 bp; single-stranded, linear
  oligonucleotide primer
ccatcatggttggctaagcatatctcct

SEQ ID NO: 1105 - DNA, 26 bp; single-stranded, linear
  oligonucleotide primer
ctggctgcattcccagcaactacgtg

SEQ ID NO: 1106 - DNA, 26 bp; single-stranded, linear
  oligonucleotide primer
caggttgcacagcccgtcattcacct

SEQ ID NO: 1107 - DNA, 26 bp; single-stranded, linear
  oligonucleotide primer
tgggtcggcctctacctttgcacttc

SEQ ID NO: 1108 - DNA, 29 bp; single-stranded, linear
  oligonucleotide primer
cgatgtggcatacttgttcttgacagtca

SEQ ID NO: 1109 - DNA, 28 bp; single-stranded, linear
  oligonucleotide primer
ttctgagggacacatcaagattgccgat

SEQ ID NO: 1110 - DNA, 28 bp; single-stranded, linear
  oligonucleotide primer
tgggataggctacgttgtgttccatgat

SEQ ID NO: 1111 - DNA, 28 bp; single-stranded, linear
  oligonucleotide primer
catttgaaaggcttctgggaccttgcat

SEQ ID NO: 1112 - DNA, 28 bp; single-stranded, linear
  oligonucleotide primer
ggcatctacacaaacacattctcagtgg

SEQ ID NO: 1113 - DNA, 28 bp; single-stranded, linear
  oligonucleotide primer
aggttgctacgatttctgcaaacggaga

SEQ ID NO: 1114 - DNA, 28 bp; single-stranded, linear
  oligonucleotide primer
ccaaaggcttacggtgagcattggcaat

SEQ ID NO: 1115 - DNA, 26 bp; single-stranded, linear
  oligonucleotide primer
tgaagcctgagagtggaggtaaccac

SEQ ID NO: 1116 - DNA, 25 bp; single-stranded, linear
  oligonucleotide primer
gccaagtcccggtgaacgtattgcc

SEQ ID NO: 1117 - DNA, 28 bp; single-stranded, linear
  oligonucleotide primer
ttgctgcgagaacgacatcaacatcctg

SEQ ID NO: 1118 - DNA, 28 bp; single-stranded, linear
  oligonucleotide primer
tctgtaatccttgcatcagtgtagggag

SEQ ID NO: 1119 - DNA, 28 bp; single-stranded, linear
  oligonucleotide primer
tattcgatgccatgttccctgtcactca

SEQ ID NO: 1120 - DNA, 25 bp; single-stranded, linear
  oligonucleotide primer
gaggtccgtcttggctttcacggtc

SEQ ID NO: 1121 - DNA, 25 bp; single-stranded, linear
  oligonucleotide primer
tcttctgtctgttgcagcggaggcg

SEQ ID NO: 1122 - DNA, 26 bp; single-stranded, linear
  oligonucleotide primer
ctggctatgggctctgcacaacgctt

SEQ ID NO: 1123 - DNA, 28 bp; single-stranded, linear
  oligonucleotide primer
ggtgagaattgaggactgtcccattaac

SEQ ID NO: 1124 - DNA, 28 bp; single-stranded, linear
  oligonucleotide primer
tttgcttgagctgctagaactgaatggg

SEQ ID NO: 1125 - DNA, 27 bp; single-stranded, linear
  oligonucleotide primer
gctgccattgagcggaagattcaactg

SEQ ID NO: 1126 - DNA, 26 bp; single-stranded, linear
  oligonucleotide primer
caccttgtcgcagagcaagtagagct

SEQ ID NO: 1127 - DNA, 26 bp; single-stranded, linear
  oligonucleotide primer
aacaggctctggcccacccatatctg

SEQ ID NO: 1128 - DNA, 26 bp; single-stranded, linear
  oligonucleotide primer
caaagtggataagccaagacgggctg

SEQ ID NO: 1129 - DNA, 26 bp; single-stranded, linear
  oligonucleotide primer
ggtagcttgcacctgtcccaactgta

SEQ ID NO: 1130 - DNA, 28 bp; single-stranded, linear
  oligonucleotide primer
gcagtaatcaaagtatcatctcgcgcag

SEQ ID NO: 1131 - DNA, 26 bp; single-stranded, linear
  oligonucleotide primer
caatatccagtaccaggcggtccctc

SEQ ID NO: 1132 - DNA, 26 bp; single-stranded, linear
  oligonucleotide primer
actggcgttcacaaggttgttgacgg

SEQ ID NO: 1133 - DNA, 27 bp; single-stranded, linear
  oligonucleotide primer
gaaacggaaacagagtggtcattcccc

SEQ ID NO: 1134 - DNA, 27 bp; single-stranded, linear
  oligonucleotide primer
gtgggattgagggtcacatcattggca

SEQ ID NO: 1135 - DNA, 28 bp; single-stranded, linear
  oligonucleotide primer
tgacggataaacacctggacccaatcag

SEQ ID NO: 1136 - DNA, 28 bp; single-stranded, linear
  oligonucleotide primer
gggttagttctggctgacgtaaatcaag

SEQ ID NO: 1137 - DNA, 26 bp; single-stranded, linear
  oligonucleotide primer
actcactgtcggtgagacacaggcag

SEQ ID NO: 1138 - DNA, 26 bp; single-stranded, linear
  oligonucleotide primer
ggtgttgtcctcactggtcagggaca

SEQ ID NO: 1139 - DNA, 26 bp; single-stranded, linear
  oligonucleotide primer
cgctacacagtttctgccagtccctg

SEQ ID NO: 1140 - DNA, 28 bp; single-stranded, linear
  oligonucleotide primer
ggcacgaatgttgtgatctttgcttcct

SEQ ID NO: 1141 - DNA, 28 bp; single-stranded, linear
  oligonucleotide primer
gaggagcacagtttgtggcttataggtg

SEQ ID NO: 1142 - DNA, 27 bp; single-stranded, linear
  oligonucleotide primer
cttaaatgctctgcccttgggtctcgt

SEQ ID NO: 1143 - DNA, 25 bp; single-stranded, linear
  oligonucleotide primer
ctcttcggccctcagatgtcccttg

SEQ ID NO: 1144 - DNA, 25 bp; single-stranded, linear
  oligonucleotide primer
cccaaggtcctatcttggccgcatc

SEQ ID NO: 1145 - DNA, 27 bp; single-stranded, linear
  oligonucleotide primer
actgcctttacctccacctgttagtcc

SEQ ID NO: 1146 - DNA, 28 bp; single-stranded, linear
  oligonucleotide primer
gagcagtcctagtggattcactgacaga

SEQ ID NO: 1147 - DNA, 28 bp; single-stranded, linear
  oligonucleotide primer
gactagaagctcaactgaaggcatgtca

SEQ ID NO: 1148 - DNA, 29 bp; single-stranded, linear
  oligonucleotide primer
gcagtacgcccagaaacaatccatttcaa

SEQ ID NO: 1149 - DNA, 28 bp; single-stranded, linear
  oligonucleotide primer
atagtgttcctgagctgccaacgatacc

SEQ ID NO: 1150 - DNA, 28 bp; single-stranded, linear
  oligonucleotide primer
gggctaaaccaggaaactacctattccc

SEQ ID NO: 1151 - DNA, 25 bp; single-stranded, linear
  oligonucleotide primer
acacggtggtggaaccctacaacgc

SEQ ID NO: 1152 - DNA, 26 bp; single-stranded, linear
  oligonucleotide primer
caggcggccatcatgttcttggcatc

SEQ ID NO: 1153 - DNA, 27 bp; single-stranded, linear
  oligonucleotide primer
tcaggactgagaacctggctaagtacg

SEQ ID NO: 1154 - DNA, 26 bp; single-stranded, linear
  oligonucleotide primer
cctaattgcttgctgaggtcgatggg

SEQ ID NO: 1155 - DNA, 28 bp; single-stranded, linear
  oligonucleotide primer
aggttcttgctggtgtgaaatgactgag

SEQ ID NO: 1156 - DNA, 28 bp; single-stranded, linear
  oligonucleotide primer
gcaccataggtacatcatccgagtcttt

SEQ ID NO: 1157 - DNA, 26 bp; single-stranded, linear
  oligonucleotide primer
gccaagtctgggaccaaagcgttcat

SEQ ID NO: 1158 - DNA, 27 bp; single-stranded, linear
  oligonucleotide primer
gtgtctgtcctcactgtgaatgatccc

SEQ ID NO: 1159 - DNA, 25 bp; single-stranded, linear
  oligonucleotide primer
gggagatgttctcacacctacggcg

SEQ ID NO: 1160 - DNA, 26 bp; single-stranded, linear
  oligonucleotide primer
acggccttgttgtagcctttgctcag

SEQ ID NO: 1161 - DNA, 26 bp; single-stranded, linear
  oligonucleotide primer
atgtaccctggcattgccgaccgaat

SEQ ID NO: 1162 - DNA, 28 bp; single-stranded, linear
  oligonucleotide primer
taacgagtcagagctttggctaggaatg

SEQ ID NO: 1163 - DNA, 23 bp; single-stranded, linear
  oligonucleotide primer
gagaagcgtcgcatccggcggga

SEQ ID NO: 1164 - DNA, 23 bp; single-stranded, linear
  oligonucleotide primer
actacagcgcccaccgagccacc

SEQ ID NO: 1165 - DNA, 24 bp; single-stranded, linear
  oligonucleotide primer
ccctgccgccctgtaccttgtatc

SEQ ID NO: 1166 - DNA, 26 bp; single-stranded, linear
  oligonucleotide primer
agacattggctagggtggcatctgca

SEQ ID NO: 1167 - DNA, 25 bp; single-stranded, linear
  oligonucleotide primer
ctacagcgcggagctgtctagtgag

SEQ ID NO: 1168 - DNA, 25 bp; single-stranded, linear
  oligonucleotide primer
gctgttacagggcctcgaactcgtc

SEQ ID NO: 1169 - DNA, 24 bp; single-stranded, linear
  oligonucleotide primer
acgaggagcggcaggacgagcatg

SEQ ID NO: 1170 - DNA, 25 bp; single-stranded, linear
  oligonucleotide primer
cgggctaaggctttacttggcggca

SEQ ID NO: 1171 - DNA, 28 bp; single-stranded, linear
  oligonucleotide primer
accttcgagaacctcatacccattctga

SEQ ID NO: 1172 - DNA, 26 bp; single-stranded, linear
  oligonucleotide primer
gggatttaagggctggattagtgccc

SEQ ID NO: 1173 - DNA, 28 bp; single-stranded, linear
  oligonucleotide primer
aggaaatggctcgtcaccttcgtgaata

SEQ ID NO: 1174 - DNA, 28 bp; single-stranded, linear
  oligonucleotide primer
ggagtgtcggttgttaagaactagagct

SEQ ID NO: 1175 - DNA, 23 bp; single-stranded, linear
  oligonucleotide primer
gggctggtcaccaccacgccgac

SEQ ID NO: 1176 - DNA, 23 bp; single-stranded, linear
  oligonucleotide primer
cccgcgtagctgctcaggttcgc

SEQ ID NO: 1177 - DNA, 24 bp; single-stranded, linear
  oligonucleotide primer
tgcgtgagctgcgacggcaaggtg

SEQ ID NO: 1178 - DNA, 26 bp; single-stranded, linear
  oligonucleotide primer
ggttgctatgccgcagttgcgtcatg

SEQ ID NO: 1179 - DNA, 26 bp; single-stranded, linear
  oligonucleotide primer
atctggtctgtgggctgcattctggc

SEQ ID NO: 1180 - DNA, 26 bp; single-stranded, linear
  oligonucleotide primer
ctggctcatccgtcgggtcatagtac

SEQ ID NO: 1181 - DNA, 28 bp; single-stranded, linear
  oligonucleotide primer
tgctgagattgattctgatgacaccgga

SEQ ID NO: 1182 - DNA, 28 bp; single-stranded, linear
  oligonucleotide primer
gcgatctacttcttgctgatagcgtttg

SEQ ID NO: 1183 - DNA, 28 bp; single-stranded, linear
  oligonucleotide primer
actcagaaccagaaacttcagcgacagt

SEQ ID NO: 1184 - DNA, 28 bp; single-stranded, linear
  oligonucleotide primer
cagatactgtgatggcatgagggacatg

SEQ ID NO: 1185 - DNA, 28 bp; single-stranded, linear
  oligonucleotide primer
tacatggagacagacttggctaatgtgc

SEQ ID NO: 1186 - DNA, 28 bp; single-stranded, linear
  oligonucleotide primer
attacgctgagaagctcctgacgatctt

SEQ ID NO: 1187 - DNA, 25 bp; single-stranded, linear
  oligonucleotide primer
ctgccctttgggcgactgaactacc

SEQ ID NO: 1188 - DNA, 28 bp; single-stranded, linear
  oligonucleotide primer
gctactatgtccttgtgactgtacttgc

SEQ ID NO: 1189 - DNA, 26 bp; single-stranded, linear
  oligonucleotide primer
gggtcctctgtgaacttgctcaggac

SEQ ID NO: 1190 - DNA, 25 bp; single-stranded, linear
  oligonucleotide primer
ctggatagtcagcaccagggtggtg

SEQ ID NO: 1191 - DNA, 26 bp; single-stranded, linear
  oligonucleotide primer
cccgagatagtgctggaacactgctg

SEQ ID NO: 1192 - DNA, 27 bp; single-stranded, linear
  oligonucleotide primer
gagcacacctgctcctcggaatctatt

SEQ ID NO: 1193 - DNA, 26 bp; single-stranded, linear
  oligonucleotide primer
acgatcagggttgccctcggtgtaag

SEQ ID NO: 1194 - DNA, 28 bp; single-stranded, linear
  oligonucleotide primer
cagtgggatcttcaaagagttgtaccct

SEQ ID NO: 1195 - DNA, 28 bp; single-stranded, linear
  oligonucleotide primer
aagaagtcaacaggcccaagatacctca

SEQ ID NO: 1196 - DNA, 30 bp; single-stranded, linear
  oligonucleotide primer
cttgtaaattccgttccttgcattgagagg

SEQ ID NO: 1197 - DNA, 28 bp; single-stranded, linear
  oligonucleotide primer
aatgatgcttggctctggaatgccagaa

SEQ ID NO: 1198 - DNA, 28 bp; single-stranded, linear
  oligonucleotide primer
gctgagagttattaacagtgcagtgtgg

SEQ ID NO: 1199 - DNA, 25 bp; single-stranded, linear
  oligonucleotide primer
ctagctgtggcaggagccacttctc

SEQ ID NO: 1200 - DNA, 27 bp; single-stranded, linear
  oligonucleotide primer
gccgacgagacagtagaggtaatagag

SEQ ID NO: 1201 - DNA, 24 bp; single-stranded, linear
  oligonucleotide primer
cccgaagtcatcctgggtatgggc

SEQ ID NO: 1202 - DNA, 26 bp; single-stranded, linear
  oligonucleotide primer
tcgtctacagagatccgcttgtcagg

SEQ ID NO: 1203 - DNA, 28 bp; single-stranded, linear
  oligonucleotide primer
gatatggctcctgggcagagttatcaac

SEQ ID NO: 1204 - DNA, 28 bp; single-stranded, linear
  oligonucleotide primer
gtatcattaacctttatgagccggtccc

SEQ ID NO: 1205 - DNA, 26 bp; single-stranded, linear
  oligonucleotide primer
tggagaacctggatggccttagggtt

SEQ ID NO: 1206 - DNA, 28 bp; single-stranded, linear
  oligonucleotide primer
caggacaccaaagatcaaggtgcttcat

SEQ ID NO: 1207 - DNA, 28 bp; single-stranded, linear
  oligonucleotide primer
aatgacaaccttctggttggtagggaca

SEQ ID NO: 1208 - DNA, 32 bp; single-stranded, linear
  oligonucleotide primer
ccttgttgttgataggatgtttgcttgaagtt

SEQ ID NO: 1209 - DNA, 26 bp; single-stranded, linear
  oligonucleotide primer
cacaagacctctgacagcacgttcct

SEQ ID NO: 1210 - DNA, 28 bp; single-stranded, linear
  oligonucleotide primer
cgctctaccatctggctgctcaaatgaa

SEQ ID NO: 1211 - DNA, 28 bp; single-stranded, linear
  oligonucleotide primer
atccagtaccatcactgagagcctcatg

SEQ ID NO: 1212 - DNA, 28 bp; single-stranded, linear
  oligonucleotide primer
agaactggcacctttgggatctcacaaa

SEQ ID NO: 1213 - DNA, 26 bp; single-stranded, linear
  oligonucleotide primer
acctcgctcgcagacaccacaagata

SEQ ID NO: 1214 - DNA, 28 bp; single-stranded, linear
  oligonucleotide primer
ttgtcagacgccttccaatatagatccc

SEQ ID NO: 1215 - DNA, 26 bp; single-stranded, linear
  oligonucleotide primer
tcaccgggaaactgtgaacggctcat

SEQ ID NO: 1216 - DNA, 26 bp; single-stranded, linear
  oligonucleotide primer
gggattacaggtgtgagtaaccacgc

SEQ ID NO: 1217 - DNA, 26 bp; single-stranded, linear
  oligonucleotide primer
cagaccagagctgtctgaactcacgt

SEQ ID NO: 1218 - DNA, 28 bp; single-stranded, linear
  oligonucleotide primer
ggattcctagtggtgttgatagtccttc

SEQ ID NO: 1219 - DNA, 26 bp; single-stranded, linear
  oligonucleotide primer
ctgcctcagtctgaaggacaaaccca

SEQ ID NO: 1220 - DNA, 29 bp; single-stranded, linear
  oligonucleotide primer
ctttggcccttggagtttcaaatgattgc

SEQ ID NO: 1221 - DNA, 26 bp; single-stranded, linear
  oligonucleotide primer
tccaccaggcagaagatgacagactg

SEQ ID NO: 1222 - DNA, 28 bp; single-stranded, linear
  oligonucleotide primer
tgaatagtgttctggcagtgtctacgga

SEQ ID NO: 1223 - DNA, 24 bp; single-stranded, linear
  oligonucleotide primer
cttcccagcggactccgagcacaa

SEQ ID NO: 1224 - DNA, 24 bp; single-stranded, linear
  oligonucleotide primer
tgtcagatgccagggtctggtcgg

SEQ ID NO: 1225 - DNA, 26 bp; single-stranded, linear
  oligonucleotide primer
tgttaccacacccagggctatgagga

SEQ ID NO: 1226 - DNA, 27 bp; single-stranded, linear
  oligonucleotide primer
gaagatgtgagggcaggataggtgaga

SEQ ID NO: 1227 - DNA, 29 bp; single-stranded, linear
  oligonucleotide primer
tcaagccagttaccctcatctacttgaac

SEQ ID NO: 1228 - DNA, 31 bp; single-stranded, linear
  oligonucleotide primer
gtagactatccaggattggaattacacaagt

SEQ ID NO: 1229 - DNA, 27 bp; single-stranded, linear
  oligonucleotide primer
atctggtagtatgccaggaatgtgccc

SEQ ID NO: 1230 - DNA, 26 bp; single-stranded, linear
  oligonucleotide primer
gcataacaagcaggacgctactccct

SEQ ID NO: 1231 - DNA, 28 bp; single-stranded, linear
  oligonucleotide primer
ggcaatatggagactcagcagttggaag

SEQ ID NO: 1232 - DNA, 28 bp; single-stranded, linear
  oligonucleotide primer
tagtagagtccagcacttgctaactctc

SEQ ID NO: 1233 - DNA, 26 bp; single-stranded, linear
  oligonucleotide primer
agctggacgccatatctagtttgccc

SEQ ID NO: 1234 - DNA, 25 bp; single-stranded, linear
  oligonucleotide primer
ggtgcaagataaggcagggtgaggg

SEQ ID NO: 1235 - DNA, 27 bp; single-stranded, linear
  oligonucleotide primer
gagctgaagcagatgcaggacaagtac

SEQ ID NO: 1236 - DNA, 28 bp; single-stranded, linear
  oligonucleotide primer
gaccagttcaccattcctcaagtgcaag

SEQ ID NO: 1237 - DNA, 28 bp; single-stranded, linear
  oligonucleotide primer
tctatgagctgacatctcagttcactgg

SEQ ID NO: 1238 - DNA, 28 bp; single-stranded, linear
  oligonucleotide primer
caaagtgactggatgtaccaggttccct

SEQ ID NO: 1239 - DNA, 28 bp; single-stranded, linear
  oligonucleotide primer
aatttggtctatgccaggcccatttcct

SEQ ID NO: 1240 - DNA, 27 bp; single-stranded, linear
  oligonucleotide primer
cagttgtgtcatcttggctcaccacag

SEQ ID NO: 1241 - DNA, 28 bp; single-stranded, linear
  oligonucleotide primer
tctatgagctgacatctcagttcactgg

SEQ ID NO: 1242 - DNA, 28 bp; single-stranded, linear
  oligonucleotide primer
caaagtgactggatgtaccaggttccct

SEQ ID NO: 1243 - DNA, 26 bp; single-stranded, linear
  oligonucleotide primer
tgaaagaccagagcaggaacaagggc

SEQ ID NO: 1244 - DNA, 26 bp; single-stranded, linear
  oligonucleotide primer
actgtgtagctgctgtggtcatcagg

SEQ ID NO: 1245 - DNA, 27 bp; single-stranded, linear
  oligonucleotide primer
tttagcccagatagtcgccatgtcctc

SEQ ID NO: 1246 - DNA, 28 bp; single-stranded, linear
  oligonucleotide primer
ctcctgtgatgatactgctacactgttc

SEQ ID NO: 1247 - DNA, 23 bp; single-stranded, linear
  oligonucleotide primer
tgcagcgtggcccgtgacacgca

SEQ ID NO: 1248 - DNA, 24 bp; single-stranded, linear
  oligonucleotide primer
accgcgatctcagccaaactccgg

SEQ ID NO: 1249 - DNA, 23 bp; single-stranded, linear
  oligonucleotide primer
gcgctacgcagcgccggagttcg

SEQ ID NO: 1250 - DNA, 24 bp; single-stranded, linear
  oligonucleotide primer
ggtgggatgagggtcgcaaggtcc

SEQ ID NO: 1251 - DNA, 26 bp; single-stranded, linear
  oligonucleotide primer
agtggccgtagcaacaaggttgcacg

SEQ ID NO: 1252 - DNA, 27 bp; single-stranded, linear
  oligonucleotide primer
gctgtcacctgggaacattccattggt

SEQ ID NO: 1253 - DNA, 27 bp; single-stranded, linear
  oligonucleotide primer
cagaagcaaatccgactctgtagggag

SEQ ID NO: 1254 - DNA, 27 bp; single-stranded, linear
  oligonucleotide primer
gacggccttagaacataaccacatccc

SEQ ID NO: 1255 - DNA, 28 bp; single-stranded, linear
  oligonucleotide primer
gagaggcatttagctgatctcttacccc

SEQ ID NO: 1256 - DNA, 28 bp; single-stranded, linear
  oligonucleotide primer
ctagccgctttccaccaactcagtcatt

SEQ ID NO: 1257 - DNA, 26 bp; single-stranded, linear
  oligonucleotide primer
ggacagaggatttctgcttaggcccc

SEQ ID NO: 1258 - DNA, 27 bp; single-stranded, linear
  oligonucleotide primer
gtcccttattcaggtgagggtcaatgg

SEQ ID NO: 1259 - DNA, 27 bp; single-stranded, linear
  oligonucleotide primer
tttcctgcctgtaacacggttcatccc

SEQ ID NO: 1260 - DNA, 30 bp; single-stranded, linear
  oligonucleotide primer
gggaataccactgacaggtgctcaataata

SEQ ID NO: 1261 - DNA, 26 bp; single-stranded, linear
  oligonucleotide primer
aacaagctggtgatgcccaactaccc

SEQ ID NO: 1262 - DNA, 26 bp; single-stranded, linear
  oligonucleotide primer
aatggcattcctggaggacacgggat

SEQ ID NO: 1263 - DNA, 26 bp; single-stranded, linear
  oligonucleotide primer
gttgggctggtcacagccttgtgatg

SEQ ID NO: 1264 - DNA, 28 bp; single-stranded, linear
  oligonucleotide primer
cagcggtttgcagttctcacgaacatag

SEQ ID NO: 1265 - DNA, 26 bp; single-stranded, linear
  oligonucleotide primer
gcccggctagaaatcaacgtgctcaa

SEQ ID NO: 1266 - DNA, 25 bp; single-stranded, linear
  oligonucleotide primer
caaggatcacctcaggcgggcgata

SEQ ID NO: 1267 - DNA, 28 bp; single-stranded, linear
  oligonucleotide primer
ttgtccaggacgatgagacactcaaaga

SEQ ID NO: 1268 - DNA, 28 bp; single-stranded, linear
  oligonucleotide primer
actatggttctgataccggctttcatgg

SEQ ID NO: 1269 - DNA, 26 bp; single-stranded, linear
  oligonucleotide primer
ttccagtgggatgggagcttatcacg

SEQ ID NO: 1270 - DNA, 28 bp; single-stranded, linear
  oligonucleotide primer
aggcactaggaggttgaacaggatcatt

SEQ ID NO: 1271 - DNA, 26 bp; single-stranded, linear
  oligonucleotide primer
gcacacccacatggtcaagttcaacc

SEQ ID NO: 1272 - DNA, 26 bp; single-stranded, linear
  oligonucleotide primer
gcagatccctgagagccacactgtct

SEQ ID NO: 1273 - DNA, 26 bp; single-stranded, linear
  oligonucleotide primer
aagagcaccggcaaggccaacaagat

SEQ ID NO: 1274 - DNA, 28 bp; single-stranded, linear
  oligonucleotide primer
cacgagatgacctcttgacacttgtcca

SEQ ID NO: 1275 - DNA, 27 bp; single-stranded, linear
  oligonucleotide primer
gatcctttgctctgcacgagttacctg

SEQ ID NO: 1276 - DNA, 26 bp; single-stranded, linear
  oligonucleotide primer
tttgtggctcttgagaggcagggact

SEQ ID NO: 1277 - DNA, 26 bp; single-stranded, linear
  oligonucleotide primer
gagagtcgaggacctccatgtaggtg

SEQ ID NO: 1278 - DNA, 27 bp; single-stranded, linear
  oligonucleotide primer
gaaagtgtctgccaggtacagcgtctt

SEQ ID NO: 1279 - DNA, 25 bp; single-stranded, linear
  oligonucleotide primer
agcgaaactgcaccagcgagtcgtc

SEQ ID NO: 1280 - DNA, 26 bp; single-stranded, linear
  oligonucleotide primer
tgcagacgcaggcagtgtcaattcga

SEQ ID NO: 1281 - DNA, 27 bp; single-stranded, linear
  oligonucleotide primer
agctgggaaacgtgggttcaatttgcc

SEQ ID NO: 1282 - DNA, 28 bp; single-stranded, linear
  oligonucleotide primer
ttatcccacccagattcacatggtcaca

SEQ ID NO: 1283 - DNA, 24 bp; single-stranded, linear
  oligonucleotide primer
cccggaccgctgtggacttggttg

SEQ ID NO: 1284 - DNA, 25 bp; single-stranded, linear
  oligonucleotide primer
gtataagtctcaggcccggccagtc

SEQ ID NO: 1285 - DNA, 24 bp; single-stranded, linear
  oligonucleotide primer
agcgtggcgaccaggctttcactg

SEQ ID NO: 1286 - DNA, 24 bp; single-stranded, linear
  oligonucleotide primer
cctggcccgtgttggagtagaagg

SEQ ID NO: 1287 - DNA, 26 bp; single-stranded, linear
  oligonucleotide primer
cctggcccagtaaaggatgtgttctc

SEQ ID NO: 1288 - DNA, 27 bp; single-stranded, linear
  oligonucleotide primer
gatgaccgtcacagagattcaccagtg

SEQ ID NO: 1289 - DNA, 30 bp; single-stranded, linear
  oligonucleotide primer
tttcatatctcgaacctcaatcccaaatgc

SEQ ID NO: 1290 - DNA, 30 bp; single-stranded, linear
  oligonucleotide primer
gaaagcacttgtggtatccgaggtaatcta

SEQ ID NO: 1291 - DNA, 28 bp; single-stranded, linear
  oligonucleotide primer
ttcggcttgtgaggcttcccactattta

SEQ ID NO: 1292 - DNA, 28 bp; single-stranded, linear
  oligonucleotide primer
ggcaacattaaaggcatggaccgtaaag

SEQ ID NO: 1293 - DNA, 24 bp; single-stranded, linear
  oligonucleotide primer
tccaaccagcacctgcggcgagag

SEQ ID NO: 1294 - DNA, 24 bp; single-stranded, linear
  oligonucleotide primer
tggaggcgcagcagacgaacacct

SEQ ID NO: 1295 - DNA, 28 bp; single-stranded, linear
  oligonucleotide primer
ctgggcctcaacgattacctagacattg

SEQ ID NO: 1296 - DNA, 28 bp; single-stranded, linear
  oligonucleotide primer
gggcaccgagatgtagtagtaagtctct

SEQ ID NO: 1297 - DNA, 26 bp; single-stranded, linear
  oligonucleotide primer
cctcctgctagataactactccgacc

SEQ ID NO: 1298 - DNA, 26 bp; single-stranded, linear
  oligonucleotide primer
gctgtagtaccagtcccggttgtcct

SEQ ID NO: 1299 - DNA, 24 bp; single-stranded, linear
  oligonucleotide primer
tccgccgtgcagcacgtcaacctg

SEQ ID NO: 1300 - DNA, 24 bp; single-stranded, linear
  oligonucleotide primer
gtccacgctctccagctcggtcac

SEQ ID NO: 1301 - DNA, 24 bp; single-stranded, linear
  oligonucleotide primer
cgatcaagaagctgtccgggcctc

SEQ ID NO: 1302 - DNA, 24 bp; single-stranded, linear
  oligonucleotide primer
ccgccggttgctgctacatgaacg

SEQ ID NO: 1303 - DNA, 28 bp; single-stranded, linear
  oligonucleotide primer
gttgctccagctctgaataaaccgaaga

SEQ ID NO: 1304 - DNA, 28 bp; single-stranded, linear
  oligonucleotide primer
tctacaatcctctgcaatacagggtcgt

SEQ ID NO: 1305 - DNA, 26 bp; single-stranded, linear
  oligonucleotide primer
gcaggactgcaccagaaattcaccac

SEQ ID NO: 1306 - DNA, 26 bp; single-stranded, linear
  oligonucleotide primer
acatcctgagcaagcatcggtctcct

SEQ ID NO: 1307 - DNA, 27 bp; single-stranded, linear
  oligonucleotide primer
tgcagatgatgggcagcaacgactatg

SEQ ID NO: 1308 - DNA, 25 bp; single-stranded, linear
  oligonucleotide primer
catgcagacgttggtccggtttccc

SEQ ID NO: 1309 - DNA, 24 bp; single-stranded, linear
  oligonucleotide primer
cgattggcaatccagtgccgcgct

SEQ ID NO: 1310 - DNA, 28 bp; single-stranded, linear
  oligonucleotide primer
tggagactgagaagtaggcatctgtact

SEQ ID NO: 1311 - DNA, 26 bp; single-stranded, linear
  oligonucleotide primer
ccgatccacctcaccttggaatctcc

SEQ ID NO: 1312 - DNA, 26 bp; single-stranded, linear
  oligonucleotide primer
ctgggtcggctctccatagtctaact

SEQ ID NO: 1313 - DNA, 23 bp; single-stranded, linear
  oligonucleotide primer
cccaggagaccgttgcagtcggc

SEQ ID NO: 1314 - DNA, 28 bp; single-stranded, linear
  oligonucleotide primer
gatgcaatgccaggtgggattgtacttc

SEQ ID NO: 1315 - DNA, 25 bp; single-stranded, linear
  oligonucleotide primer
cctgccctagtgcaacaggcattgc

SEQ ID NO: 1316 - DNA, 24 bp; single-stranded, linear
  oligonucleotide primer
agctcatcccaagcctagccctcc

SEQ ID NO: 1317 - DNA, 26 bp; single-stranded, linear
  oligonucleotide primer
ggcatgggcattacgggtgttgaagg

SEQ ID NO: 1318 - DNA, 26 bp; single-stranded, linear
  oligonucleotide primer
gggtgaagctcagtttcatcttccgg

SEQ ID NO: 1319 - DNA, 24 bp; single-stranded, linear
  oligonucleotide primer
atggcgctcacctggcaaacccac

SEQ ID NO: 1320 - DNA, 27 bp; single-stranded, linear
  oligonucleotide primer
gagcagtcaggcagaaatgactcgtga

SEQ ID NO: 1321 - DNA, 26 bp; single-stranded, linear
  oligonucleotide primer
ttcttcattcaggcttgccgagggac

SEQ ID NO: 1322 - DNA, 28 bp; single-stranded, linear
  oligonucleotide primer
gtgtgggtcatcagactgagactcaaag

SEQ ID NO: 1323 - DNA, 28 bp; single-stranded, linear
  oligonucleotide primer
ttggagtctgggcatcacgatgattgag

SEQ ID NO: 1324 - DNA, 26 bp; single-stranded, linear
  oligonucleotide primer
ccaccaatccacagtagggtcaaccg

SEQ ID NO: 1325 - DNA, 27 bp; single-stranded, linear
  oligonucleotide primer
gaagcctgaagacacaaacagacgctc

SEQ ID NO: 1326 - DNA, 26 bp; single-stranded, linear
  oligonucleotide primer
gcaaggaccttccagtcctacttgtc

SEQ ID NO: 1327 - DNA, 31 bp; single-stranded, linear
  oligonucleotide primer
aaacctagaagatgcttgtgatgacatcatg

SEQ ID NO: 1328 - DNA, 30 bp; single-stranded, linear
  oligonucleotide primer
aactgaactttcaaatctgctaacactcgc

SEQ ID NO: 1329 - DNA, 26 bp; single-stranded, linear
  oligonucleotide primer
catggacttcaggctgttagtggcag

SEQ ID NO: 1330 - DNA, 28 bp; single-stranded, linear
  oligonucleotide primer
cagttaagtgagaactgtgcgaacacag

SEQ ID NO: 1331 - DNA, 23 bp; single-stranded, linear
  oligonucleotide primer
ggcttgccagccacccgtccagt

SEQ ID NO: 1332 - DNA, 26 bp; single-stranded, linear
  oligonucleotide primer
ctttacgggctccaggcattcccatg

SEQ ID NO: 1333 - DNA, 23 bp; single-stranded, linear
  oligonucleotide primer
cccagtgctgcctgcattcgcgg

SEQ ID NO: 1334 - DNA, 26 bp; single-stranded, linear
  oligonucleotide primer
cagtcatggcctcatagacggcagtg

SEQ ID NO: 1335 - DNA, 26 bp; single-stranded, linear
  oligonucleotide primer
gactggaggccagccatcacaatcaa

SEQ ID NO: 1336 - DNA, 25 bp; single-stranded, linear
  oligonucleotide primer
cgggcaattcagcgaatcgagaccg

SEQ ID NO: 1337 - DNA, 28 bp; single-stranded, linear
  oligonucleotide primer
cagaataccaccgccaggatgttactag

SEQ ID NO: 1338 - DNA, 30 bp; single-stranded, linear
  oligonucleotide primer
caacagttggtcacagaggtcaagtattat

SEQ ID NO: 1339 - DNA, 23 bp; single-stranded, linear
  oligonucleotide primer
ccgctgcaccaagccatgcgggc

SEQ ID NO: 1340 - DNA, 23 bp; single-stranded, linear
  oligonucleotide primer
cagccgcgtctccaggtaggcca

SEQ ID NO: 1341 - DNA, 29 bp; single-stranded, linear
  oligonucleotide primer
aactgaaacacagtgctctgtgcctatac

SEQ ID NO: 1342 - DNA, 30 bp; single-stranded, linear
  oligonucleotide primer
gagtcattgtccataggtggaaacttgaca

SEQ ID NO: 1343 - DNA, 24 bp; single-stranded, linear
  oligonucleotide primer
cctggacaccggctatgagaccga

SEQ ID NO: 1344 - DNA, 26 bp; single-stranded, linear
  oligonucleotide primer
ctccgactgacttcggaacacaagac

SEQ ID NO: 1345 - DNA, 28 bp; single-stranded, linear
  oligonucleotide primer
atgactgggttattgagcctgttgtggg

SEQ ID NO: 1346 - DNA, 28 bp; single-stranded, linear
  oligonucleotide primer
tcactgatttgcaggcagctcgtttctt

SEQ ID NO: 1347 - DNA, 28 bp; single-stranded, linear
  oligonucleotide primer
tggcttcaccatcaatcctgattcctct

SEQ ID NO: 1348 - DNA, 28 bp; single-stranded, linear
  oligonucleotide primer
ccatgtgactgaatcaagacccggtatg

SEQ ID NO: 1349 - DNA, 26 bp; single-stranded, linear
  oligonucleotide primer
gtggctatgctggagagcttggcttc

SEQ ID NO: 1350 - DNA, 27 bp; single-stranded, linear
  oligonucleotide primer
gccaacagtcctcacttagggctttct

SEQ ID NO: 1351 - DNA, 28 bp; single-stranded, linear
  oligonucleotide primer
cccatagagttgtgacgaggattgagat

SEQ ID NO: 1352 - DNA, 30 bp; single-stranded, linear
  oligonucleotide primer
taaagcatcacagtgctgtagtagatgtct

SEQ ID NO: 1353 - DNA, 29 bp; single-stranded, linear
  oligonucleotide primer
ggaaagtggaatgaaccgtttgacgaaac

SEQ ID NO: 1354 - DNA, 28 bp; single-stranded, linear
  oligonucleotide primer
tcaacaattcccaaatgccgaagcacag

SEQ ID NO: 1355 - DNA, 29 bp; single-stranded, linear
  oligonucleotide primer
agctattaaagccttggagcttcggtttc

SEQ ID NO: 1356 - DNA, 28 bp; single-stranded, linear
  oligonucleotide primer
atcattaccacctgctgcaatgagtctg

SEQ ID NO: 1357 - DNA, 26 bp; single-stranded, linear
  oligonucleotide primer
agctgacgggatctccatccgattcc

SEQ ID NO: 1358 - DNA, 26 bp; single-stranded, linear
  oligonucleotide primer
tcatagcggaaggctttgcagtctgc

SEQ ID NO: 1359 - DNA, 29 bp; single-stranded, linear
  oligonucleotide primer
aaacccagattggtgagataggacacttg

SEQ ID NO: 1360 - DNA, 25 bp; single-stranded, linear
  oligonucleotide primer
ctttccgggacacctgggttcacac

SEQ ID NO: 1361 - DNA, 23 bp; single-stranded, linear
  oligonucleotide primer
gggagaccgcagcccatcggcat

SEQ ID NO: 1362 - DNA, 29 bp; single-stranded, linear
  oligonucleotide primer
gactagatcactgcatccgcctatacaat

SEQ ID NO: 1363 - DNA, 28 bp; single-stranded, linear
  oligonucleotide primer
ctaatggtggctggtcatccaaatcctg

SEQ ID NO: 1364 - DNA, 29 bp; single-stranded, linear
  oligonucleotide primer
ggttcataatttcgtctggcagtgttgtg

SEQ ID NO: 1365 - DNA, 28 bp; single-stranded, linear
  oligonucleotide primer
agtggccctgttaaaggctctttatgga

SEQ ID NO: 1366 - DNA, 30 bp; single-stranded, linear
  oligonucleotide primer
gctgacacaactgcttcaaagcaatgattt

SEQ ID NO: 1367 - DNA, 29 bp; single-stranded, linear
  oligonucleotide primer
gaagagcctattgaagatgaacagactcc

SEQ ID NO: 1368 - DNA, 29 bp; single-stranded, linear
  oligonucleotide primer
ctcccaagtcctccatagcagtgtattaa

SEQ ID NO: 1369 - DNA, 26 bp; single-stranded, linear
  oligonucleotide primer
tttcctgtcccaccatacgagcacct

SEQ ID NO: 1370 - DNA, 27 bp; single-stranded, linear
  oligonucleotide primer
cgcaacaagacagcagcaagttctgag

SEQ ID NO: 1371 - DNA, 24 bp; single-stranded, linear
  oligonucleotide primer
aaagcccggagctaacgaccggcc

SEQ ID NO: 1372 - DNA, 26 bp; single-stranded, linear
  oligonucleotide primer
ccgaaacggttgactccgttgggatc

SEQ ID NO: 1373 - DNA, 51 bp; single-stranded, linear
tctagaattcagcggccgcttttttttttttttttttttttttttttttvn

SEQ ID NO: 1374 - DNA, 25 bp; single-stranded, linear
  oligonucleotide primer
ctaatacgactcactatagggcggg

SEQ ID NO: 1375 - DNA (cDNA), 22 bp; single-stranded, linear
  oligonucleotide primer
ctaatacgactcactatagggc

What is claimed is:

1. A pool of at least fifty distinct gene specific primers in solution, wherein each constituent primer member of said pool has a different sequence and is complementary to a sequence of a different gene.

2. The pool of gene specific primers according to claim 1, wherein said pool is a pool of at least seventy five distinct gene specific primers.

3. The pool of gene specific primers according to claim 1, wherein said pool comprises from 50 to 10,000 gene specific primers.

4. A kit for use in detecting differential expression of genes of a plurality of physiological sources, the kit comprising:

a pool of at least fifty distinct gene specific primers in solution, wherein each constituent primer member of said pool has a different sequence and is complementary to a sequence of a different gene.

5. The kit according to claim 4, wherein the pool of gene specific primers comprises from 50 to 10,000 gene specific primers.

6. The kit according to claim 4, wherein the pool of gene specific primers comprises from 75 to 10,000 gene specific primers.

7. The kit according to claim 4, wherein said kit further comprises at least one array of probe nucleic acids stably associated to the surface of a substrate.

8. The kit according to claim 4, wherein said kit further comprises a DNA polymerase, dNTPs and labeled dNTPs.

9. A kit for use in detecting differential expression of genes of a plurality of physiological sources, the kit comprising:

a pool of from 50 to 10,000 gene specific primers in solution, wherein each constituent primer member of said pool has a different sequence and is complementary to a sequence of a different gene.

10. The kit according to claim 9, wherein said kit further comprises at least one array of probe nucleic acids stably associated to the surface of a substrate.

11. The kit according to claim 9, wherein said kit further comprises reverse transcriptase, dNTPs and labeled dNTPs.

* * * * *